United States Patent 11,446,398 (REGULATED BIOCIRCUIT SYSTEMS) - sequence listing, part 67

SEQ ID NO: 165457 - DNA, 3474 bp, Homo sapiens
  Payload ID: 12570
  Gene Symbol: PDE8B
  Gene Name: phosphodiesterase 8B
  Uniprot ID: O95263
  ENST ID: ENST00000505283
  CDS Start-End: 781-1833
gtggcatgctggtgggcatagcttatggggaggtgcttctgccctgttctacctagtcctcaatttggccccatgtccgagtcccttctcctacctcactgccataccatcgtgggtttcctctccagagaatgctgtgaggaaccagtgagtgattccacctcaattttatgtggttttggggaagcggagcgagagaagagcaagtaaaaccaagaatctcttgccatacacacgttacaggcaggacaattgtggctgttgttacttctgtatttactcagtttttaaaattaagctcttggcctaaagatccaacatgtaacttcaggggagtccttcattaattaatactactttaaaccttagcacacatcgtctgggaatgacaaataagcatttctttttttttaaatttaattttattattattatactttaagttttagggtacatgtgcacaacgtgcaggtttgttacatatgtatacatgtgccatgttggtgtgcatttctaaatgacttttaagcaaagatctagatgattgaggtactcagagatcaaaggtggagggaaggaaactgagattcaggaacacttggggactagttcaagagccaggatatggccaagcattggaatttcgtccactctcttaacgctgcatctccaaggacctcaagcccagaaactcttctttaaaaggacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatt

SEQ ID NO: 165458 - DNA, 736 bp, Homo sapiens
  Payload ID: 12570
  Gene Symbol: PDE8B
  Gene Name: phosphodiesterase 8B
  ENST ID: ENST00000505926
  CDS Start-End: 387-736
agcgagggagggaggggacgggcgcagaccgaaagtggggaaagaagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacagggtatgtacaagata

SEQ ID NO: 165459 - DNA, 535 bp, Homo sapiens
  Payload ID: 12570
  Gene Symbol: PDE8B
  Gene Name: phosphodiesterase 8B
  ENST ID: ENST00000502945
  CDS Start-End: 200-535
aataattcatatgcagtacaatgatatcacatgggtttccatttctgaaaaagtttgccaatccctggtctactggagcaggttggagaagctgtgagctcgttgaggaaagtgactaagctttacaaaggaaaagagccagcaggcaacatggtgttcttgttggcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacagg

SEQ ID NO: 165460 - DNA, 2058 bp, Homo sapiens
  Payload ID: 12571
  Gene Symbol: PDE9A
  Gene Name: phosphodiesterase 9A
  Uniprot ID: O76083
  ENST ID: ENST00000291539
  CDS Start-End: 61-1842
cgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165461 - DNA, 1956 bp, Homo sapiens
  Payload ID: 12571
  Gene Symbol: PDE9A
  Gene Name: phosphodiesterase 9A
  Uniprot ID: O76083
  ENST ID: ENST00000328862
  CDS Start-End: 37-1740
acagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165462 - DNA, 1883 bp, Homo sapiens
  Payload ID: 12571
  Gene Symbol: PDE9A
  Gene Name: phosphodiesterase 9A
  Uniprot ID: O76083
  ENST ID: ENST00000335512
  CDS Start-End: 66-1667
cctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165463 - DNA, 1728 bp, Homo sapiens
  Payload ID: 12571
  Gene Symbol: PDE9A
  Gene Name: phosphodiesterase 9A
  Uniprot ID: O76083
  ENST ID: ENST00000335440
  CDS Start-End: 37-1512
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165464 - DNA, 1616 bp, Homo sapiens
  Payload ID: 12571
  Gene Symbol: PDE9A
  Gene Name: phosphodiesterase 9A
  Uniprot ID: O76083
  ENST ID: ENST00000349112
  CDS Start-End: 3-1400
ggatgggatccggctcctccagctaccggcccaaggccatctacctggacatcgatggacgcattcagaagcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165465 - DNA, 1875 bp, Homo sapiens
  Payload ID: 12571
  Gene Symbol: PDE9A
  Gene Name: phosphodiesterase 9A
  Uniprot ID: O76083
  ENST ID: ENST00000380328
  CDS Start-End: 37-1659
acagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacggaatgagctcattctctatacatcactccgtaacttgttgtttttacctagtaaggagtcatgggcgtcccaccagcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165466 - DNA, 1671 bp, Homo sapiens
  Payload ID: 12571
  Gene Symbol: PDE9A
  Gene Name: phosphodiesterase 9A
  Uniprot ID: O76083
  ENST ID: ENST00000398224
  CDS Start-End: 55-1455
ggatgggatccggctcctccagctaccggcccaaggccatctacctggacatcgatggacgcattcagaagcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165467 - DNA, 1963 bp, Homo sapiens
  Payload ID: 12571
  Gene Symbol: PDE9A
  Gene Name: phosphodiesterase 9A
  Uniprot ID: O76083
  ENST ID: ENST00000398225
  CDS Start-End: 89-1747
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165468 - DNA, 1606 bp, Homo sapiens
  Payload ID: 12571
  Gene Symbol: PDE9A
  Gene Name: phosphodiesterase 9A
  Uniprot ID: O76083
  ENST ID: ENST00000398227
  CDS Start-End: 89-1390
acagtaaaaagtccgagtgcagccgccgggcgcaggatgggatccggctcctccagctaccggcccaaggccatctacctggacatcgatggacgcattcagaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165469 - DNA, 1684 bp, Homo sapiens
  Payload ID: 12571
  Gene Symbol: PDE9A
  Gene Name: phosphodiesterase 9A
  Uniprot ID: O76083
  ENST ID: ENST00000398229
  CDS Start-End: 89-1468
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165470 - DNA, 1885 bp, Homo sapiens
  Payload ID: 12571
  Gene Symbol: PDE9A
  Gene Name: phosphodiesterase 9A
  Uniprot ID: O76083
  ENST ID: ENST00000398232
  CDS Start-End: 89-1669
acagtaaaaagtccgagtgcagccgccgggcgcaggatgggatccggctcctccagctaccggcccaaggccatctacctggacatcgatggacgcattcagaagcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165471 - DNA, 1783 bp, Homo sapiens
  Payload ID: 12571
  Gene Symbol: PDE9A
  Gene Name: phosphodiesterase 9A
  Uniprot ID: O76083
  ENST ID: ENST00000398234
  CDS Start-End: 89-1567
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165472 - DNA, 1776 bp, Homo sapiens
  Payload ID: 12571
  Gene Symbol: PDE9A
  Gene Name: phosphodiesterase 9A
  Uniprot ID: O76083
  ENST ID: ENST00000398236
  CDS Start-End: 37-1560
acagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 165473 - DNA, 4341 bp, Homo sapiens
  Payload ID: 12572
  Gene Symbol: PCK1
  Gene Name: phosphoenolpyruvate carboxykinase 1 (soluble)
  Uniprot ID: P35558
  ENST ID: ENST00000319441
  CDS Start-End: 165-2033
atttaaagctgggaggttctgccaccaagcacggccttcccactgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcgcctctgtcaaagatcggcatcgagctgacggattcaccctacgtggtggccagcatgcggatcatgacgcggatgggcacgcccgtcctggaagcagtgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatgtgtgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagatggatttgctttgcttggtttttcttatttgagctaccaagaggagagaactctgattaaatatcttgtgatttaaatcctgccccctccccaagaaggtggggacgttcagaatcacacttgaagagggggtgcattgcctggtcccagggagaaggagggagcagatggggaggaatgaggcagggaaccatggttggggttttctgaatttgctgaagccactagttggcatcctttaacaattctacaaacctttagatggtgaggcttatgtggcaggactgggagggtttaatgcatgctttttgacagtttggatctggaggggtctcaggcttccacaaaaattacattgtggacagtttcataggattttgccttttaactcttcaaagcaacagttttctcaactgtcatccccgcgggggagcagaggaagacaagtgagaaggaaaaggggacaggatctgggttgagcaagcattaattgagcgccttctgtatcccggacatcatgccaacaccatgggctgcccgagaagagaggtgggtggtttggtccccagctctgccttgaaccctcacctgctctcctctactcccagtgtttattggatattccagaacagtccaaacgaaccataaactttatatcacagattcaatctgtgtaaatactattatcttcaagttgtagtttctttcttgggcccaggctgtgaaattggcttcacccctaccacaccccagcgggcaggcttgttcttatgtcacactccacccctccagtctcctcaactggaaaacttgcctcttttcctcacttcctctgctccttacaatggcttcatatggaaggtgaagctgagatcaccccaattttacaggtgaggaaactgaggtcaagctaggagcgtccagcggggctgagaaattgccaggatttccttccccattaaggagctgagagtcttagctccagacacgttggcttgttagaatatcaaaaccaccgaaggggaaaaaccacttactggaattaaatgctatctgctgtattagtttaaatcagtggcgttcaaacttgtttctccttttcactgcggaacacgttcttgacatgtacttgactcagagtcccatgtctaaaggagacagagcccaaggcagcccacctgaagctggggagggagtccaaagtgcaagccacctggtctccatttccccgccccttgggggcctttgggcagctccttggacccctgaaagaggccaccaggataaactttgttaaaatgcatgccttgtgccccactgtcctattacgggctttcagtagtctccactccctcggcaggcaaagacactggccatctccaaattccctcccctcctgcacagcatcagccacctggcaagcagtctcacataggaccatttgccagcaggccctgcaagcctgggggacagcctagaggaggtgacttacatacacagcataagagttttcaggagaccaaaaagattcaatatatgtcattaactcctgactcagtttccccaaaccatgcctcctgagtgctccctctgtctccaaatcctgatttttgtgcgcggacccctgtctacaataaacaggatcctatgacttc

SEQ ID NO: 165474 - DNA, 2357 bp, Homo sapiens
  Payload ID: 12573
  Gene Symbol: PCK2
  Gene Name: phosphoenolpyruvate carboxykinase 2 (mitochondrial)
  Uniprot ID: Q16822
  ENST ID: ENST00000216780
  CDS Start-End: 269-2191
ggcggtttggaggcaggggttggggcggcggctgggctgacctggagcctggagccccggggccgagggagctggcctgccagcggggcggaggaaagctagtgccagccctaccaggttccgcccccgcgcctgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacacaa

SEQ ID NO: 165475 - DNA, 1830 bp, Homo sapiens
  Payload ID: 12573
  Gene Symbol: PCK2
  Gene Name: phosphoenolpyruvate carboxykinase 2 (mitochondrial)
  ENST ID: ENST00000396973
  CDS Start-End: 248-1573
ggggcggcggctgggctgacctggagcctggagccccggggccgagggagctggcctgccagcggggcggaggaaagctagtgccagccctaccaggttccgcccccgcgcctgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtatgtgcggtggggaaggtgtggcacagcctccaggcctcagcaccttaatggtggaaaagctttctccacaacctccaaccatcttctaggactgccaggaggcacagaagtcatgaacgtttgcagtttccagtcccaggcaaaatctcagttcatgtcccaactccaccagtcactggttttgtgatctggctaagttgctcaacttccctaagctttagtttccacatcagttgaatgagggtagttgtgatagtacctatctcatgagattgttggaggattaaatagtgcataaaaagggtttatcacactgacaaatacacagtaaattctcaataataaa

SEQ ID NO: 165476 - DNA, 2505 bp, Homo sapiens
  Payload ID: 12573
  Gene Symbol: PCK2
  Gene Name: phosphoenolpyruvate carboxykinase 2 (mitochondrial)
  ENST ID: ENST00000545054
  CDS Start-End: 919-2439
agcctctgctgtggctcgcttcgccgcgctccctccttccccgccttccatacctccccggctccgctcggttcctggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctccgccaggtttcccatcctaggcggaggcgggcaggggcgactgctgtgggtccagcctcccgcgccgcgcgtctcttgggagggcagccggccggtgctcctcgtttccgcctgcacctccccttctctgcctcgctcgcctctgaccgcgcgatctctatctgccactctcagaacttcctctctctcctcgctcctctctgctgagccaggtctccgcatatcctcctttccttcccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcag

SEQ ID NO: 165477 - DNA, 666 bp, Homo sapiens
  Payload ID: 12573
  Gene Symbol: PCK2
  Gene Name: phosphoenolpyruvate carboxykinase 2 (mitochondrial)
  ENST ID: ENST00000559584
  CDS Start-End: 50-238
cccggctccgctcggttcctggccaccccgcagcccctgcccaggtgccatggccgcattgtaccgccctggcctgcgatacctccctcggacctctaacgggctctcagccagcgccccagggtacttcgagaggcagcagggccctggggacaaggcttttgtcccagagtcggaagtgacccacatctgtcgcacagcccgttccacttgggcagcccttgtgggtggtctctgaaggaaacgtcccacttagagggctgcaagagggtgtgggggcttcacaagagataacgtgagccaggctccagggagagagaggctgtcctcaagactgtgtgcttgaaaactgatgctcacggagaacttccctctgaggcaggaacagacccaggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaagg

SEQ ID NO: 165478 - DNA, 1804 bp, Homo sapiens
  Payload ID: 12573
  Gene Symbol: PCK2
  Gene Name: phosphoenolpyruvate carboxykinase 2 (mitochondrial)
  ENST ID: ENST00000559250
  CDS Start-End: 17-1546
gggagggcggtggcggatggggggcggggcctcgaagtcgggggccgaagagtggacccagtcctccaatgggagagatgggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctatttta

SEQ ID NO: 165479 - DNA, 826 bp, Homo sapiens
  Payload ID: 12573
  Gene Symbol: PCK2
  Gene Name: phosphoenolpyruvate carboxykinase 2 (mitochondrial)
  ENST ID: ENST00000559503
  CDS Start-End: 1-367
tgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctggtgagggcctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcct

SEQ ID NO: 165480 - DNA, 2433 bp, Homo sapiens
  Payload ID: 12573
  Gene Symbol: PCK2
  Gene Name: phosphoenolpyruvate carboxykinase 2 (mitochondrial)
  ENST ID: ENST00000558096
  CDS Start-End: 843-2267
ggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctccgccaggtttcccatcctaggcggaggcgggcaggggcgactgctgtgggtccagcctcccgcgccgcgcgtctcttgggagggcagccggccggtgctcctcgtttccgcctgcacctccccttctctgcctcgctcgcctctgaccgcgcgatctctatctgccactctcagaacttcctctctctcctcgctcctctctgctgagccaggtctccgcatatcctcctttccttcccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacacaa

SEQ ID NO: 165481 - DNA, 756 bp, Homo sapiens
  Payload ID: 12573
  Gene Symbol: PCK2
  Gene Name: phosphoenolpyruvate carboxykinase 2 (mitochondrial)
  ENST ID: ENST00000559837
  CDS Start-End: 435-756
ccggggccgagggagctggcctgccagcggggcggaggaaagctagtgccagccctaccaggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccg

SEQ ID NO: 165482 - DNA, 508 bp, Homo sapiens
  Payload ID: 12573
  Gene Symbol: PCK2
  Gene Name: phosphoenolpyruvate carboxykinase 2 (mitochondrial)
  ENST ID: ENST00000559171
  CDS Start-End: 1-328
cattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaagagatggggtttcgtcacattgcccaggctgatctcaaattcctgtggtcaagcgagctgcccgcctcagcctctcaaagtactgggattacaggtgtgagctaccacgcctattatactttctaatgaaaaaatgaaaccacatcgtttttgcatctattacatgtcaccagaagaaatgattatctttatttttttaacttgacaatgtagtttgcacaatttcctatggtataaaaatagaaggctacaacaaacctataccaggaataggtaccttaaaaaaaaattgaagactacaacacc

SEQ ID NO: 165483 - DNA, 897 bp, Homo sapiens
  Payload ID: 12573
  Gene Symbol: PCK2
  Gene Name: phosphoenolpyruvate carboxykinase 2 (mitochondrial)
  ENST ID: ENST00000560736
  CDS Start-End: 559-897
gcaggggttggggcggcggctgggctgacctggagcctggagccccggggccgagggagctggcctgccagcggggcggaggaaagctagtgccagccctaccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatc

SEQ ID NO: 165484 - DNA, 2012 bp, Homo sapiens
  Payload ID: 12573
  Gene Symbol: PCK2
  Gene Name: phosphoenolpyruvate carboxykinase 2 (mitochondrial)
  ENST ID: ENST00000561286
  CDS Start-End: 332-1852
gtggctcgcttcgccgcgctccctccttccccgccttccatacctccccggctccgctcggttcctggccaccccgcagcccctgcccaggtgccatggccgcattgtaccgccctggcctgcgatacctccctcggacctctaacgggctctcagccagcgccccagggtacttcgagaggcagcagggccctggggacaaggctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctatttt

SEQ ID NO: 165485 - DNA, 782 bp, Homo sapiens
  Payload ID: 12573
  Gene Symbol: PCK2
  Gene Name: phosphoenolpyruvate carboxykinase 2 (mitochondrial)
  ENST ID: ENST00000560106
  CDS Start-End: 126-254
ctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcgatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgaccc

SEQ ID NO: 165486 - DNA, 2912 bp, Homo sapiens
  Payload ID: 12574
  Gene Symbol: PFKL
  Gene Name: phosphofructokinase, liver
  Uniprot ID: P17858
  ENST ID: ENST00000349048
  CDS Start-End: 56-2398
gcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagca

SEQ ID NO: 165487 - DNA, 3390 bp, Homo sapiens
  Payload ID: 12574
  Gene Symbol: PFKL
  Gene Name: phosphofructokinase, liver
  ENST ID: ENST00000397961
  CDS Start-End: 56-184
gcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagca

SEQ ID NO: 165488 - DNA, 129 bp, Homo sapiens
  Payload ID: 12574
  Gene Symbol: PFKL
  Gene Name: phosphofructokinase, liver
  ENST ID: ENST00000628044
  CDS Start-End: 1-129
atggccgcggtggacctggagaagctgcgggcgtcgggcgcgggcaaggccatcggcgtcctgaccagcggcggcgacgcgcaaggtcccctgacaagcccaccaggccccctgctgagatggctgtga

SEQ ID NO: 165489 - DNA, 3078 bp, Homo sapiens
  Payload ID: 12575
  Gene Symbol: PFKM
  Gene Name: phosphofructokinase, muscle
  Uniprot ID: P08237
  ENST ID: ENST00000312352
  CDS Start-End: 40-2382
agacttggtatagtgggagagcctgactgagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgcttttgcttctcctgttatcatcttcctaagtggaatgtaatactgtcagccccatgtatcagacacttgtctgatgaagcagtaaagacgttaagggtatcacagggggtggaggaagggattatctctagtacactacttgctggctgtctgaaaaattgtcactgccaaactctaaaaacagttctaaatagtgactgagaaggtttgttgctggagtcagggaataaggcagccaaatactctttgcacagttctttagtgggaagagaaattaacaataaatatcaagcactgtg

SEQ ID NO: 165490 - DNA, 3176 bp, Homo sapiens
  Payload ID: 12575
  Gene Symbol: PFKM
  Gene Name: phosphofructokinase, muscle
  Uniprot ID: P08237
  ENST ID: ENST00000340802
  CDS Start-End: 225-2780
gcttccgcccagtccagcccgggccggctgaccgggtccgacacagtctcctggaccaggctccctccatcctcacccctcccccagcttcccgccgccactcaccgaaccggaaccggctgccatgcgaaggggtttccggccgggcgcggaacgcaaaacccgggaaccgccgcgaaccggaaccgccttcacagcaccggaagagtcgctaggaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 165491 - DNA, 3228 bp, Homo sapiens
  Payload ID: 12575
  Gene Symbol: PFKM
  Gene Name: phosphofructokinase, muscle
  Uniprot ID: P08237
  ENST ID: ENST00000359794
  CDS Start-End: 190-2532
aagcaggaggaggcggagccttcttgtcagcatctgttagtggaggttgggaagcctctcctccttccccctccctctttgcctccacctggctcctccccatgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgcttttgcttctcctgttatcatcttcctaagtggaatgtaatactgtcagccccatgtatcagacacttgtctgatgaagcagtaaagacgttaagggtatcacagggggtggaggaagggattatctctagtacactacttgctggctgtctgaaaaattgtcactgccaaactctaaaaacagttctaaatagtgactgagaaggtttgttgctggagtcagggaataaggcagccaaatactctttgcacagttctttagtgggaagagaaattaacaataaatatcaagcactgtg

SEQ ID NO: 165492 - DNA, 585 bp, Homo sapiens
  Payload ID: 12575
  Gene Symbol: PFKM
  Gene Name: phosphofructokinase, muscle
  ENST ID: ENST00000546465
  CDS Start-End: 56-585
atcttgattcctgctgtgtcttaactgaccattgtcttaaattctagagtggatcatgacccatgaagagcaccatgcagccaaaaccctggggattggcaaagccattgctgtcttaacctctggtggagatgcccaaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctgg

SEQ ID NO: 165493 - DNA, 887 bp, Homo sapiens
  Payload ID: 12575
  Gene Symbol: PFKM
  Gene Name: phosphofructokinase, muscle
  ENST ID: ENST00000552752
  CDS Start-End: 1-125
tgagcctctctggtaaccaggctgtgcgcctgcccctcatggaatgtgtccaggtgaccaaagatgtgaccaaggccatggatgagaagaaatttgacgaagccctgaagctgagaggccggtgaggagatgacgggaagctcactagctacagaaatcagaggcgtgaacgaagccaaagatctccatggctccaggcccaaaacatgagcttctgctgcttccttttctgattctctctgcagcaagttcctgcccaagaaaattagttgtgaggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacc

SEQ ID NO: 165494 - DNA, 571 bp, Homo sapiens
  Payload ID: 12575
  Gene Symbol: PFKM
  Gene Name: phosphofructokinase, muscle
  ENST ID: ENST00000549022
  CDS Start-End: 89-571
atttcagcttgtcagtctacaagggtgtggctttcctctggaagaagtccaaagctctcaggctgcaaagctcagacttgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctg

SEQ ID NO: 165495 - DNA, 594 bp, Homo sapiens
  Payload ID: 12575
  Gene Symbol: PFKM
  Gene Name: phosphofructokinase, muscle
  ENST ID: ENST00000549941
  CDS Start-End: 137-594
acagtgctccccgcttccgcccagtccagcccgggccggctgaccgggtccgacacagtctcctggaccaggctccctccatcctcacccctcccccagcttcccgccgccactcaccgaaccggaaccggctgccatgcgaaggggtttccggccgggcgcggaacgcaaaacccgggaaccgccgcgaaccggaaccgccttcacagcaccggaagagtcgctagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatgg

SEQ ID NO: 165496 - DNA, 452 bp, Homo sapiens
  Payload ID: 12575
  Gene Symbol: PFKM
  Gene Name: phosphofructokinase, muscle
  ENST ID: ENST00000550924
  CDS Start-End: 199-452
accacagaaagccgagcttcccggtgaaaacagctctccccagagaagacccagctctggcgggaaagccccggaatcgcaaccggcctttccccaagtacggctgggcgctgggatggggcctgctgtaacggcagggagacggtctctccgcggcccaggagagagagaccagaaggaacggcctcagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattgg

SEQ ID NO: 165497 - DNA, 580 bp, Homo sapiens
  Payload ID: 12575
  Gene Symbol: PFKM
  Gene Name: phosphofructokinase, muscle
  ENST ID: ENST00000552989
  CDS Start-End: 65-244
ctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgt

SEQ ID NO: 165498 - DNA, 3579 bp, Homo sapiens
  Payload ID: 12575
  Gene Symbol: PFKM
  Gene Name: phosphofructokinase, muscle
  ENST ID: ENST00000547581
  CDS Start-End: 42-572
aaccgccttcacagcaccggaagagtcgctaggaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgaatgtgcagaggtagagatacaagtaagcaagaggaagagggcagtggtaaaagcaagaggagacccgactgtggagacaatgaagcaaagggaagagtggatcatgacccatgaagagcaccatgcagccaaaaccctggggattggcaaagccattgctgtcttaacctctggtggagatgcccaagagatgggacgggatcggccaggtgcagtggctcacacctgtaatcccaggactttgggaggccgaggcgggcagatcacccgaggttgggagttcgagaccagcctgaccaacatggagaaaccccgtctctactaaaaatacaaaattagctgggcgtggtggtgcatgcctgtaatcccagccacttgggaggctgaggcaggagaatcgcttgaacccgggaggcagaggttgcggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatgttcgtatgaatgaagccagagaggccttagaatccatagcccattcccttctggcttctgagtctcctgacattgcttctccccttggtccttctgcacatctctccctggttccctgcccctgattgcctcccacaaagaaccattacaagacaagaggctgagctgtccatggtttacccaagtctctgcttgttttcttcctttgactctgcgtaaccctctctctgtccctctgttggtcccttcagctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 165499 - DNA, 571 bp, Homo sapiens
  Payload ID: 12575
  Gene Symbol: PFKM
  Gene Name: phosphofructokinase, muscle
  ENST ID: ENST00000550257
  CDS Start-End: 125-571
gcttccgcccagtccagcccgggccggctgaccgggtccgacacagtctcctggaccaggctccctccatcctcacccctcccccagcttcccgccgccactcaccgaaccggaaccggctgccatgcgaaggggtttccggccgggcgcggaacgcaaaacccgggaaccgccgcgaaccggaaccgccttcacagcaccggaagagtcgctagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatg

SEQ ID NO: 165500 - DNA, 582 bp, Homo sapiens
  Payload ID: 12575
  Gene Symbol: PFKM
  Gene Name: phosphofructokinase, muscle
  ENST ID: ENST00000548288
  CDS Start-End: 158-582
gagttttgcttgcttgcgttccagtttccatggcagcttttcgcggtggccctaaatctgcggaaacctgtggcttcccccgacagatagggacctgagatctaaatcgatctcaggctatctcgtgttttattgagaatcacagaacgaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctggga

SEQ ID NO: 165501 - DNA, 2797 bp, Homo sapiens
  Payload ID: 12575
  Gene Symbol: PFKM
  Gene Name: phosphofructokinase, muscle
  Uniprot ID: P08237
  ENST ID: ENST00000551804
  CDS Start-End: 152-2401
aatatctgtctgtttttgtctacgtgcgtgtcattgtgggtctgtaagggatgcttatacatgagtctgcatgaatttctgtgtcctgtgcctctataactgtcttagagatttcaggagaagaatatgagcggtttttacagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 165502 - DNA, 526 bp, Homo sapiens
  Payload ID: 12575
  Gene Symbol: PFKM
  Gene Name: phosphofructokinase, muscle
  ENST ID: ENST00000551339
  CDS Start-End: 108-526
aatctgcaagaaagcagcggcggaggagagctaagactaaaaggcaagaggggccattgagtgaagagcaagggggagagctgggagtgaggtgggaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctcca

SEQ ID NO: 165503 - DNA, 689 bp, Homo sapiens
  Payload ID: 12575
  Gene Symbol: PFKM
  Gene Name: phosphofructokinase, muscle
  ENST ID: ENST00000551485
  CDS Start-End: 64-372
tttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgctcagttccctaaaaatccatgggcaaaaatttaatatgcagtgtctagtgaaggctctacctaggtgctaagtaatggtgcctgccataaagtggtctgagaatgagccagaattctccaccagtatcccaaagtcatggctgcccaggagtacatatgatatgaaaacctaagtatacttacctctctcagggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaaga

SEQ ID NO: 165504 - DNA, 616 bp, Homo sapiens
  Payload ID: 12575
  Gene Symbol: PFKM
  Gene Name: phosphofructokinase, muscle
  ENST ID: ENST00000547066
  CDS Start-End: 152-373
agtggaggttgggaagcctctcctccttccccctccctctttgcctccacctggctcctccccatgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaagagatgggacgggatcggccaggtgcagtggctcacacctgtaatcccaggactttgggaggccgaggcgggcagatcacccgaggttgggagttcgagaccagcctgaccaacatggagaaaccccgtctctactaaaaatacaaaattagctgggcgtggtggtgcatgcctgtaatcccagccacttgggaggctgaggcaggagaatcgcttgaacccgggaggcagaggttgcggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgat

SEQ ID NO: 165505 - DNA, 626 bp, Homo sapiens
  Payload ID: 12575
  Gene Symbol: PFKM
  Gene Name: phosphofructokinase, muscle
  ENST ID: ENST00000552792
  CDS Start-End: 178-626
gaagaggagggggctggggcaggaggtcaaagaacagagttaaggaccagtggggcgcctgcgcggtgtggcgaggcccgagaagcgaagggagcatttaagactagtcgtaatttctcagtacccttttcagtctgggctttttcgctttctcgtactcggaatactgaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagct

SEQ ID NO: 165506 - DNA, 492 bp, Homo sapiens
  Payload ID: 12575
  Gene Symbol: PFKM
  Gene Name: phosphofructokinase, muscle
  ENST ID: ENST00000548345
  CDS Start-End: 25-492
gagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcagatgacgactgggaggaacacctttgtcgccgactcagcgag

SEQ ID NO: 165507 - DNA, 2867 bp, Homo sapiens
  Payload ID: 12575
  Gene Symbol: PFKM
  Gene Name: phosphofructokinase, muscle
  Uniprot ID: P08237
  ENST ID: ENST00000547587
  CDS Start-End: 129-2471
agacttggtatagtgggagagcctgactgaggtggctctagccagtctaattgccgttcctttagctagtggcatcttgattcctgctgtgtcttaactgaccattgtcttaaattctagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 165508 - DNA, 570 bp, Homo sapiens
  Payload ID: 12575
  Gene Symbol: PFKM
  Gene Name: phosphofructokinase, muscle
  ENST ID: ENST00000549366
  CDS Start-End: 76-570
acagcaccggaagagtcgctaggtggctgaagaggagggggctggggcaggaggtcaaagaacagagaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgaatgtgcagaggtagagatacaagtaagcaagaggaagagggcagtggtaaaagcaagaggagacccgactgtggagacaatgaagcaaagggaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtgga

SEQ ID NO: 165509 - DNA, 594 bp, Homo sapiens
  Payload ID: 12575
  Gene Symbol: PFKM
  Gene Name: phosphofructokinase, muscle
  ENST ID: ENST00000549003
  CDS Start-End: 245-594
tttctgatggtggcactagcgatatcacatctcagggagataccacagagtaggagagttggagaaatgtttacgtgagacgcagaagtagtcaagaaatatcactcgggtctcaaggaaggcgggagatgaagccggtaccacagaaagccgagcttcccggtgaaaacagctctccccagagaagacccagctctggcgggaaagccccggaatcgcaaccggcctttccccaaagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgg

SEQ ID NO: 165510 - DNA, 289 bp, Homo sapiens
  Payload ID: 12575
  Gene Symbol: PFKM
  Gene Name: phosphofructokinase, muscle
  ENST ID: ENST00000553055
  CDS Start-End: 1-289
cccatttgtggtcattcctgctacagtctccaacaatgtccctggctcagacttcagcgttggggctgacacagcactcaatactatctgcacagcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccattt

SEQ ID NO: 165511 - DNA, 590 bp, Homo sapiens
  Payload ID: 12575
  Gene Symbol: PFKM
  Gene Name: phosphofructokinase, muscle
  ENST ID: ENST00000546755
  CDS Start-End: 215-590
accgccttcacagcaccggaagagtcgctaggtggctgaagaggagggggctggggcaggaggtcaaagaacagagttaaggaccagtggggcgcctgcgcggtgtggcgaggcccgagaagcgaagggagcatttaagactagtcgtaatttctcagtacccttttcagtctgggctttttcgctttctcgtactcggaatactgaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgaatgtgcagaggtagagatacaagtaagcaagaggaagagggcagtggtaaaagcaagaggagacccgactgtggagacaatgaagcaaagggaagagtggatcatgacccatgaagagcaccatgcagccaaaaccctggggattggcaaagccattgctgtcttaacct

SEQ ID NO: 165512 - DNA, 762 bp, Homo sapiens
  Payload ID: 12575
  Gene Symbol: PFKM
  Gene Name: phosphofructokinase, muscle
  ENST ID: ENST00000550345
  CDS Start-End: 290-762
ggtagtagataaaaggctttatatgaatattacaagaatcaccaccactccaaatataataagtgtaccaaatatgaagtaaaatgactttaacaaggctgacttgaaagtgataaagaagcaagttactgctaacaagatagtggaaatactgcacaggcaccgataaacagaaatcaccaagctcaaggaaagagaaacgaggcatagatccagagatcacgttagggtacaccaagaaagagacggttcaagggaattaccaggaggcgatgagccagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacat

SEQ ID NO: 165513 - DNA, 381 bp, Homo sapiens
  Payload ID: 12575
  Gene Symbol: PFKM
  Gene Name: phosphofructokinase, muscle
  ENST ID: ENST00000629846
  CDS Start-End: 73-381
cctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgctcagttccctaaaaatccatgggcaaaaatttaatatgcagtgtctagtgaaggctctacctaggtgctaa

SEQ ID NO: 165514 - DNA, 1698 bp, Homo sapiens
  Payload ID: 12576
  Gene Symbol: PFKP
  Gene Name: phosphofructokinase, platelet
  ENST ID: ENST00000381072
  CDS Start-End: 876-1484
gaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgccta

SEQ ID NO: 165515 - DNA, 2769 bp, Homo sapiens
  Payload ID: 12576
  Gene Symbol: PFKP
  Gene Name: phosphofructokinase, platelet
  Uniprot ID: Q01813
  ENST ID: ENST00000381075
  CDS Start-End: 225-2555
atttaacattgaagagcggaaggtggcggagactcggcgcgccccaggccccgggtgcacgtgggggcgccggtgcccggatgatggagtgtcccgatccgtgcaatccctggcggggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgccta

SEQ ID NO: 165516 - DNA, 2654 bp, Homo sapiens
  Payload ID: 12576
  Gene Symbol: PFKP
  Gene Name: phosphofructokinase, platelet
  Uniprot ID: Q01813
  ENST ID: ENST00000381125
  CDS Start-End: 77-2431
gagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgcctatgactccaa

SEQ ID NO: 165517 - DNA, 705 bp, Homo sapiens
  Payload ID: 12576
  Gene Symbol: PFKP
  Gene Name: phosphofructokinase, platelet
  ENST ID: ENST00000407806
  CDS Start-End: 74-705
ttaaggaagttcacctccagatgtactcagagggcctggtcttagctgccacagatttacaaacccttacagtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctggga

SEQ ID NO: 165518 - DNA, 496 bp, Homo sapiens
  Payload ID: 12576
  Gene Symbol: PFKP
  Gene Name: phosphofructokinase, platelet
  ENST ID: ENST00000413079
  CDS Start-End: 1-496
tgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgagacctgcgaccgcatcaagcagtccgccagcggaaccaagcggcgcgtgttcatcatcgagaccatgggcggctactgtggctacctggccaacatgggggggctcgcggccggagctgatgcc

SEQ ID NO: 165519 - DNA, 1140 bp, Homo sapiens
  Payload ID: 12576
  Gene Symbol: PFKP
  Gene Name: phosphofructokinase, platelet
  ENST ID: ENST00000415005
  CDS Start-End: 420-1140
gtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggcc

SEQ ID NO: 165520 - DNA, 453 bp, Homo sapiens
  Payload ID: 12576
  Gene Symbol: PFKP
  Gene Name: phosphofructokinase, platelet
  ENST ID: ENST00000433193
  CDS Start-End: 1-311
acttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagacggtttccatgcagccgccgcggtgaactcccgtctggtggacactcccccagggcctcggtgtgatggagtttcctgaatcagcgcaggcagacgtgggacacccttgtgcaccttttcattttacttctgtttttaaataaaggccctaaatgctgcttaaaataa

SEQ ID NO: 165521 - DNA, 425 bp, Homo sapiens
  Payload ID: 12576
  Gene Symbol: PFKP
  Gene Name: phosphofructokinase, platelet
  ENST ID: ENST00000468050
  CDS Start-End: 71-425
gtggctgtcgacagcagctgccgactgtgcccaatagagaagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctag

SEQ ID NO: 165522 - DNA, 432 bp, Homo sapiens
  Payload ID: 12576
  Gene Symbol: PFKP
  Gene Name: phosphofructokinase, platelet
  ENST ID: ENST00000607886
  CDS Start-End: 93-432
gcttctatgggggctgccccctctcccatcgcagggtaactggcaccaggctgttaagctgtggatgggcaaccgcacagtgcattggatgtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacg

SEQ ID NO: 165523 - DNA, 4392 bp, Homo sapiens
  Payload ID: 12577
  Gene Symbol: PACS1
  Gene Name: phosphofurin acidic cluster sorting protein 1
  Uniprot ID: Q6VY07
  ENST ID: ENST00000320580
  CDS Start-End: 34-2925
cctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgactgc

SEQ ID NO: 165524 - DNA, 679 bp, Homo sapiens
  Payload ID: 12577
  Gene Symbol: PACS1
  Gene Name: phosphofurin acidic cluster sorting protein 1
  ENST ID: ENST00000529677
  CDS Start-End: 1-322
ggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatg

SEQ ID NO: 165525 - DNA, 548 bp, Homo sapiens
  Payload ID: 12577
  Gene Symbol: PACS1
  Gene Name: phosphofurin acidic cluster sorting protein 1
  ENST ID: ENST00000527380
  CDS Start-End: 51-548
ctcaccgtgtgatgtctggcagctgatgccagctattagctgggacctccatgagaactgtggctggaacacctgttatggcctttccacgtggctgcttggcttcctcacggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaa

SEQ ID NO: 165526 - DNA, 1688 bp, Homo sapiens
  Payload ID: 12577
  Gene Symbol: PACS1
  Gene Name: phosphofurin acidic cluster sorting protein 1
  ENST ID: ENST00000529757
  CDS Start-End: 187-1686
gcgattttccttcggctgaggcaggagctttaggaccacttgctttcaggaaaagaaaatgagtaactctctcttcaggatggtgatggggcctggccagtccaaggaggctcctgggtggtcactgagtgggaggtcatcttcactgtttcctctcctccatggtaggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgagg

SEQ ID NO: 165527 - DNA, 628 bp, Homo sapiens
  Payload ID: 12577
  Gene Symbol: PACS1
  Gene Name: phosphofurin acidic cluster sorting protein 1
  ENST ID: ENST00000524815
  CDS Start-End: 315-590
tgcaggtcgggtggcaccagctgctgtcctgaggctgcactggagccgcccgcaggggcttctgccgggctcaggccttctctccagctcgaggctcagtttggcccaggctttgcctgctgggcgtgagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgcc

SEQ ID NO: 165528 - DNA, 617 bp, Homo sapiens
  Payload ID: 12577
  Gene Symbol: PACS1
  Gene Name: phosphofurin acidic cluster sorting protein 1
  ENST ID: ENST00000531597
  CDS Start-End: 388-617
ctttattctccccagctttgttctcagatcagcctgattctcctctcctacatgagctgctctgtgtggctggagggaacagagctgcagccttcctcagcctgccctcccggggactggcatggcccctaccccatcaggcctatgtagttgggagctgaaggcagagctgacctctcctctttgttccctttcctcaggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgt

SEQ ID NO: 165529 - DNA, 540 bp, Homo sapiens
  Payload ID: 12577
  Gene Symbol: PACS1
  Gene Name: phosphofurin acidic cluster sorting protein 1
  ENST ID: ENST00000524784
  CDS Start-End: 1-270
tattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggtgcagagctagcctagggaccaaacccctgagagccgagatgcccaccccttcagggatgaaacggaggccagatcactctcccatcacaatgaggtgtcactggacttcagcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaa

SEQ ID NO: 165530 - DNA, 846 bp, Homo sapiens
  Payload ID: 12577
  Gene Symbol: PACS1
  Gene Name: phosphofurin acidic cluster sorting protein 1
  ENST ID: ENST00000528935
  CDS Start-End: 610-846
ctgtttctctgagcacctgctggccgccctctgcctctcccttcctggttcttacgctgctgcccctcctgccacccacaccgtttcccatccgcgaggcttgctgcacctccatcctctccacctgccctggcaggacaaccgctgtggctttgttcctcatctccatgtgtcctctaaggactcgctttgctgcttctttctcctcctttccatcgtggtctggccagtgggagactgagtctccctcccaaagtcctgatatctgttctctctaacacccctgctccagagactccccatgcaccagtccagcagccctgtcctcaggctccccagggactccctaacaagagacactttcttttgttcctgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagcca

SEQ ID NO: 165531 - DNA, 578 bp, Homo sapiens
  Payload ID: 12577
  Gene Symbol: PACS1
  Gene Name: phosphofurin acidic cluster sorting protein 1
  ENST ID: ENST00000533756
  CDS Start-End: 259-578
agaccagtcactgcttggatactgaggagagagcagtgaacaaaacagacagaaattccagctcttgcggagcttaccttctggggacagggtgggcagcaggcagtagtgagtgagtgagcaaatattagggtgtgttggacgggaagaataaagctggatggggataagtgggcagaggaaagaggtcacggttttaaacaaggtggtctagaaagacctcagaaagcgagccggccacatggaacacacatttagatgctgcattttttacagattgaagatttgtggcaaccctacgttgagctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagac

SEQ ID NO: 165532 - DNA, 547 bp, Homo sapiens
  Payload ID: 12577
  Gene Symbol: PACS1
  Gene Name: phosphofurin acidic cluster sorting protein 1
  ENST ID: ENST00000531298
  CDS Start-End: 1-356
aaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggctgcacccaaggcccaggagctacactggaatttggcctgtcttcctgacaggctttgagtgccaagggcagagaccaagtcctccagtcttcgtgtcttcccacagctcgtcatgaaagtgggctctggtgggtgtttattgacttgaattgaccccaagtggacgttgctgagaactgtcatgcgatttgtccctacagcaacctaacatcaaacagaagtttgtggccctcctgaagcggtttaaagtttcagatgaggtgggctttgggctggagcatgtgtcccgcgagcagatccgggaagt

SEQ ID NO: 165533 - DNA, 3708 bp, Homo sapiens
  Payload ID: 12578
  Gene Symbol: PACS2
  Gene Name: phosphofurin acidic cluster sorting protein 2
  Uniprot ID: Q86VP3
  ENST ID: ENST00000325438
  CDS Start-End: 505-3174
ggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagca

SEQ ID NO: 165534 - DNA, 2944 bp, Homo sapiens
  Payload ID: 12578
  Gene Symbol: PACS2
  Gene Name: phosphofurin acidic cluster sorting protein 2
  Uniprot ID: Q86VP3
  ENST ID: ENST00000430725
  CDS Start-End: 500-2944
cgtccccgcgcgccgcgtccagctcgatgtccgtgccgccgcaaccgcggcacacgcggcccgtcatgccggcgaccgcgcgggcagcgcccggagcctcccaagactctcaagccacccgagcctccggagcagcccgcgccgcccgcccaggcccagccgcccaggcctcgccgctctcgcgaggccccgctccagccgattcgcagccgcagattcgccgcgcgcgcccgggccgcgccgcccgcaacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctag

SEQ ID NO: 165535 - DNA, 6365 bp, Homo sapiens
  Payload ID: 12578
  Gene Symbol: PACS2
  Gene Name: phosphofurin acidic cluster sorting protein 2
  Uniprot ID: Q86VP3
  ENST ID: ENST00000447393
  CDS Start-End: 176-2890
ggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagaggaaaaagcattttcattttgactttaccctaagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggc

SEQ ID NO: 165536 - DNA, 576 bp, Homo sapiens
  Payload ID: 12578
  Gene Symbol: PACS2
  Gene Name: phosphofurin acidic cluster sorting protein 2
  ENST ID: ENST00000546915
  CDS Start-End: 317-576
aagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgag

SEQ ID NO: 165537 - DNA, 2809 bp, Homo sapiens
  Payload ID: 12578
  Gene Symbol: PACS2
  Gene Name: phosphofurin acidic cluster sorting protein 2
  ENST ID: ENST00000547217
  CDS Start-End: 33-2612
caggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacc

SEQ ID NO: 165538 - DNA, 2657 bp, Homo sapiens
  Payload ID: 12579
  Gene Symbol: PGM1
  Gene Name: phosphoglucomutase 1
  Uniprot ID: P36871
  ENST ID: ENST00000371083
  CDS Start-End: 369-2111
tgtttacagctgaagttggctgcatgcagcactccttggagctatctctaccctaacggggaaatgagacaaaaataattgaagggtatttggcttggttaagtgggcagaagtgtcctcatcaaaacaactttgaagacctgctttgtgtgtgggtgcgagtgggtgtgtggcccttaacttgttcacaagggacaacaacaacaaggaattaaccaagctttctcattgagagtgatcgtccatgcaaaccctctattttagttactcatacgacactgttgcagcttcaggttggacagacctattttggagtcccttgactgctttctggacaccctcactgagccagtcggtggaagtgaaggatgagtgattttgaagaatggatttctgggacatatagaaaaatggaagaaggtcctctccctctgttgacttttgctacagctccctaccacgatcagaaaccaggaacaagtggattacggaagaaaacctattattttgaggaaaagccatgctatctggagaatttcatccagagtatattcttttccatagacctaaaagatcgccagggatcatcactggtggttggtggagatgggcggtactttaataaatcagcaatagaaacaatagtgcagatggcagctgccaatgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttggg

SEQ ID NO: 165539 - DNA, 2472 bp, Homo sapiens
  Payload ID: 12579
  Gene Symbol: PGM1
  Gene Name: phosphoglucomutase 1
  Uniprot ID: P36871
  ENST ID: ENST00000371084
  CDS Start-End: 214-1902
cctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 165540 - DNA, 2345 bp, Homo sapiens
  Payload ID: 12579
  Gene Symbol: PGM1
  Gene Name: phosphoglucomutase 1
  Uniprot ID: P36871
  ENST ID: ENST00000540265
  CDS Start-End: 682-1779
gctcggggccggccgcttccgcgcgctgccgcctcggtttccacctcccgctcctccctctccttcgcgctcgctcttctggcctggaggcccgacggaggtcgccgggctggggaaagtggccacgggacccggcagacctgctcgcctgactcccggggcgccgggaggtgcgggcgcggagcctcccaaggtcacgcccgactctccgtctctagccgctgccttccctctccccgtcccccgcccctcccgaggcgtctgacatttgccctaaccttgcagccttggaagatacgattacggcgcagagtgctgtcgccttaagcaggaaagatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagct

SEQ ID NO: 165541 - DNA, 3264 bp, Homo sapiens
  Payload ID: 12580
  Gene Symbol: PGM2
  Gene Name: phosphoglucomutase 2
  Uniprot ID: Q96G03
  ENST ID: ENST00000381967
  CDS Start-End: 101-1939
ggctctccccgcccccgcctccgcctccacgtcttggggccgggccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatcaaatgttgtgttcatgtttggggaaaatataatttgcagaaacctatgaagtagagcaaagatgctttaaaaagataagtttttttgaactaaattttttttagttctaataatgcacataggatattagtacatcgtacacgtgctaggaaaaaacagcttcagtgtctttgtttaatgtgttgaaactcatctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaactttctttatatactttatatattttacattatttctgatttttaaagcaaatgattgccattatgattacactcaacctaaatagttatgaacagtttcagaacaatgaaaaattacaatactatgtgatagtattgtaactatttttctattttagtcatatgtcgcttatatcctaccagaactcttaaatctataatattcgatatattctacaaactgctttattgtagaagccatatttatgtttattttataatgttttctagtgtcaaactgtactgtggagaaaagaaatgttagatctgt

SEQ ID NO: 165542 - DNA, 511 bp, Homo sapiens
  Payload ID: 12580
  Gene Symbol: PGM2
  Gene Name: phosphoglucomutase 2
  ENST ID: ENST00000510084
  CDS Start-End: 1-180
tacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttat

SEQ ID NO: 165543 - DNA, 1646 bp, Homo sapiens
  Payload ID: 12580
  Gene Symbol: PGM2
  Gene Name: phosphoglucomutase 2
  ENST ID: ENST00000505986
  CDS Start-End: 15-602
gcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtggtagaagcattgaaagcattggaatggaggcttagaccatcgttgtgtttgaagaattttctagctctaccaagtagaagatggaatgagaaggcactgaggaaattactcacctttcttattaggaaatacatcctggaattatgagcagccagttaattctaaggcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggtaagaagtgatcatgaacattaaggaattggctgcaaggcaaaaggaaaaggtttggattgggattcaaagatccacagtgaaacacggtttattttgcctctccagcactcaggttgaatgtcgaactgtcctactccaaaattgacatctcagatgatttacagccaaaaggaatgtctt

SEQ ID NO: 165544 - DNA, 2050 bp, Homo sapiens
  Payload ID: 12580
  Gene Symbol: PGM2
  Gene Name: phosphoglucomutase 2
  ENST ID: ENST00000512556
  CDS Start-End: 13-273
acaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgta

SEQ ID NO: 165545 - DNA, 1415 bp, Homo sapiens
  Payload ID: 12580
  Gene Symbol: PGM2
  Gene Name: phosphoglucomutase 2
  ENST ID: ENST00000515668
  CDS Start-End: 26-613
ctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtggtagaagcattgaaagcattggaatggaggcttagaccatcgttgtgtttgaagaattttctagctctaccaagtagaagatggaatgagaaggcactgaggaaattactcacctttcttattaggaaatacatcctggaattatgagcagccagttaattctaaggcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacagactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggtagggtgtttctgggactcactcattttcctttcatctgctctgtagaagatctaaggcatgtctttctcttttggattatccctttaggaaacattaactggctttaagtggatgggaaacagagccaaacagctaatagaccaggggaaaactgttttatttgcatttgaagaagctattggtaagaagtgatcatgaacattaaggaattggctgcaaggc

SEQ ID NO: 165546 - DNA, 661 bp, Homo sapiens
  Payload ID: 12580
  Gene Symbol: PGM2
  Gene Name: phosphoglucomutase 2
  ENST ID: ENST00000625312
  CDS Start-End: 74-661
cacgtcttggggccgggccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtggtagaagcattgaaagcattggaatggaggcttagaccatcgttgtgtttgaagaattttctagctctaccaagtagaagatggaatgagaaggcactgaggaaattactcacctttcttattaggaaatacatcctggaattatga

SEQ ID NO: 165547 - DNA, 8515 bp, Homo sapiens
  Payload ID: 12581
  Gene Symbol: PGM2L1
  Gene Name: phosphoglucomutase 2-like 1
  Uniprot ID: Q6PCE3
  ENST ID: ENST00000298198
  CDS Start-End: 313-2181
gggcgggcggcggcggcggcggcggagccaggacccagacatctgggactgttgttctctcgcggcgcgaccgcctcagtcacttcgcccagagacccggacctggtccgctggggagcaggcggccataaaccccctctctcccggttccctgacgccgcggcaggagctgttacgaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataagaatcccaaaacaaaagagcagattgaaaacctgttacggaatgggatgaacaaggagctgcgagatcgtctttgttgccgaatgacttttgggactgcaggacttcgttctgccatgggggcagggttttgctatattaatgaccttacagtaatacagtcaacacaggggatgtacaaataccttgagagatgtttctcagacttcaagcagagaggctttgtggttgggtatgacactcggggtcaagtaactagcagctgcagcagccagaggcttgctaaactcactgctgcagtcttgctggccaaagatgttcctgtgtaccttttttcaagatatgttcctacaccttttgtaccatatgcagttcagaagctcaaagcagttgcaggtgtgatgattactgcctctcacaaccgcaaggaagacaatggatacaaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagacttttctaccgttaaatgtccaaatcctgaagaaggagaatctgtgctggaactttccttgagactggcagagaaagaaaatgcccgggtagtgctagccacagatcctgatgcagacagactggcagcagcagaacttcaggagaatggttgttggaaagttttcacagggaatgagttggcagctttgtttggatggtggatgtttgattgctggaagaaaaataaatcaagaaatgctgatgtgaagaacgtttatatgttagccaccacagtctcttctaaaattctgaaggcaattgcacttaaagaaggatttcattttgaagaaacattaccaggttttaaatggattggaagtaggataatagacctcctggaaaatgggaaagaagtcctttttgcatttgaagagtctattggttttctctgtggaacttcagttttggataaagatggggtgagtgcagctgttgtggttgctgagatggcatcttacctggaaaccatgaatataacattgaaacagcaactggttaaggtttatgaaaaatatggttatcatatttcaaaaacttcctatttcttgtgttatgaaccacctaccatcaaaagtatatttgaaaggcttcgtaattttgattctccaaaagaatatccaaaattttgtggaacatttgctatattgcatgtacgggacgttaccactggatatgacagtagccagcctaataagaaatcagtgctgcctgtgagtaaaaacagccaaatgattacatttacttttcaaaatggctgtgttgctacccttcggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtgtgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtaagtagatttattcttttattttatgaagtaatgttaattttactaagaataaaacatccaaattttaagtattatgaaatactaaaactacatgttttaaaacagaggtccagtttattctaacatcttgctgacttctgtagaatttctgattgcatgactattatttatcttcttttagtgtagaaaataattttttacaaaaagtcacttttgggctgggcgcagtggctcacgcctgtaatcccagcactttgggaggctgaggcaggtggatcacaatgtcaggagtttgagactagcctggccaatatggtgaaaccctgtctctactaaaaatacaaaaattagccgggtgtggtggtgggcacctgtagtcccagctactcgggaggctgaggcaggagaattgcttgaacctaggaggctgagattgcagtgagccgaaatcacgccactacactccagcctgggcaacagagggagactccatctcaaaaaaaaaaaaagtcacttttggctaatcatgcagtcttctgaaaaggtttaatagagaaatgctgtttaggctgggcttggtggctcacatctgtaataccagcgctttgggaggctgaggcaggaggattgcttgaggccaggagtttaagttacagaactatgatcacactgccgcactgaagcctggatgacagagtgagaccttatctcaaaaaaaaaaaaaaaaagagagagagagagaaaaagaaatgctgtgtttaatcttcttaaaatgtatcttgtcctacatagttctcagaatacatatggggtatagttaggagataacaataacaagacctaaacaaattgcttatgggagatagcactgtaattagagaatttatttcatataaaataataatataaagtttgaactgattagaatgttccttaaatcatggtttcgtttgttgcagctgtcagctaacatttggttgagctcatataatccaaacctaattgtccaactattgtattgccactattgttaatttgttccttccttactttcttattgttggatcttatatgactgtatgactgtagataatagacagctagctaaatgtagagcaccatttttctcaatgagtttgttttcaaaggctttgcactggagaagatatgtgtagaatttttgttttatttttaaaatgtgtaaaacatcttttgttttatatgcttttaagaatgtagattgtaatttaggaaatggcatatattctgcaaagtggtataatgttgtatatatgaaaaacaggtatatttggtttagttctgtgtttcagtgactgataaacaaaaatgaagctaaaatgaatcaacggctcattcatagttactaaagccatgtcatgactgtcattctattatgaagaaaacagttttatttgagtgctttaatataatgcaacatttaagtcatcttaaggtgaaaagttattgaagtgttcttctctcaagttaacaaaattttacaaatgttcctgaagtgtatcgattgagggaattattttattctagcctgtcatgagtctgtctgagcatgatacttaacatgaacttgatgtagtaggtgcacatttgcctaacaggataaattcagtgatagcccaagctggtcaggagagacagaagtgctggctaggaggtctcagcctcgggcactacaatgtttatctttttctttttgaacaatattgtgaaaatgattgcattctcattgagcatgaaagtcaaaactggaattttctaaagctttggagaaaaggagagaattagtagggcaagatcaaagcatacattggaaataaacagtagaaataagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagaggtagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaacaaaaatgtcataaagggcactaaaagtaacatttgggtttcactccatatctagaagaatttagctcacaaaacaatttttgtgtgttttgagtaactgatgcataagtgcaatgaataattttcctgcttcactgttatttttaatttaacctggcaaattaagtgagacttgaacaaaattttgttcatcttgaagaatgtatagtggcttaggttatttgaggttttcgttttgaatatatatgttgttattttgatgtagatacgttagcagatggagaggttctaagagattggatactttggaatgtctttatataggaaatagacctcccatttcttaagcaagttgcttctggaattgatgcaacagggatattagctgtagtttaatggataagttgttctatgagctgctgctatcagtacttttttccacattttccattgatatttgtgatgcttgaaaaatccaaacttcacttggatacatttaattttatgcctttttctctctacctcccacttttcctaggcacccttgcacattttgttactgtgaaggactattgccctgttacctcactgataagaaatctcaactgtattcattcagaatgctttaagcttagtcataaactacatttgcctatggacctttggttattttgttaatgttgtcattatatttaagacttattgtaggaagtaattttaaatctatttcataacctgttttgatctgtctgcatactgctatatgttaatttattacggccttttacaattcacttgtcatctgagattgttctagaaactgatgaggaaagagtcgtactaaccaaaatgaatgggcaattgacataacattctatttcaggtttccttgtacttggggagccaaagcacaagatctaaggaaatcttattcacatttgtccctcagagcatcttaccctaagccatagaggtataaatagtaagatgagaattgctcattgtctgactccttgcacagcatgaatttaattctagttggaaacaaagttagtgttgactactggttaccttaaagtattcaccatactatatatttattagaccatctttcctctttgtttattcaagactatgtacttataaaagagaacctataagaatgtgtagagtgaccaaatagggacaaagtgacatacctagagtttgctgctcaaatttttccactagcgtaaccctaaagcagaggggcatgatgaagggggaaggggttctgagagcaaaatcagaatcagcctaccactgacatgaagtgtgttctgtctttaaaatgtaagtgaattttgcattctttataataaaacttttaatataaaaatgatatgtttaatctttactgaaacttatgccaccacaaaggagcaccatgttcatcacgtggctgctcagttttctcccccagtgccctcacccccagtggaggcaagtccttgagctacacacactggctgtagtgcaagatatataaacataggccgggctcggtggctcatgcctgtaatcctagcactttgggaggccgaagcaggtggatcatctgaggtcgggagattgagactagcctgaccgacatggagaaaccctgtgtccactaaaaatacaaaattagccgggtgtggtggcacatgcctgtaatcccagctactcgggaggctgaggcaggagaatcacttgaacccaggaggtggaggttgtggtgagccaagatcgcgccgttgcactccagcctgggcaacaagagtgaaactccatctcaaaaaaaaaaaaaaaagatatataaacatagaacatatccagactatttcctgcccttggaatctgaccttcagaaggattaatgccaaactaaactgacctgaaacagttttgttactattggcattccttgactaaaaaggaccacctgatgctcagtcccgagagtaggaatcgtggtttattatttttcatatccataccacctagttcagtacctgttatagagtgtttaattgctgatactaggaattaagggattttttaaaagtagcaaatagtttaaggaacaatcaaaaaatgaattttctaattcagttttttcaatgaagtcccatcactgaactttataatgtaatgtttattaagcagacatccccttaaatactcagtttctttggagagagcaaagcatatctctctgtggaaattatatataatgcctggtattttacactcaaagcaaggtgttggccaggaaggtaaagaaatggtgtctatgtagacttaatatcactagtctaagtgtcattttgagcctagtagcactaccttccaagtgagtcacaacaaatttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatttatgcagtcaagaatgaattatttttctgactaaagtgtgtagcagtagttcaaaattgtgcccttgttttaacagtttctgtcaacatcttctcatttttccctacaaaaacaccagggtgtattataagtactgcctgtgagaatttgcactttatgtatttgtgtgtggatttcttgtggttttagccaaatgaagtgttatcagtaataaacaggtctcttcata

SEQ ID NO: 165548 - DNA, 2219 bp, Homo sapiens
  Payload ID: 12582
  Gene Symbol: PGM3
  Gene Name: phosphoglucomutase 3
  ENST ID: ENST00000283977
  CDS Start-End: 128-1513
tgcggttctgaggactgggtttgggtgcagacgttgttgcttgggcgcttctccgctgcgtgtaggtgaagggggcttcctgaccgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaat

SEQ ID NO: 165549 - DNA, 605 bp, Homo sapiens
  Payload ID: 12582
  Gene Symbol: PGM3
  Gene Name: phosphoglucomutase 3
  ENST ID: ENST00000504780
  CDS Start-End: 1-341
tggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaatagtaactaacatcttgacaaagaggataaactgattttggttcttgtcatggaagataaaaagtcagtatcatgagcatactatttcatgtccct

SEQ ID NO: 165550 - DNA, 2013 bp, Homo sapiens
  Payload ID: 12582
  Gene Symbol: PGM3
  Gene Name: phosphoglucomutase 3
  Uniprot ID: O95394
  ENST ID: ENST00000512866
  CDS Start-End: 56-1756
gttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaa

SEQ ID NO: 165551 - DNA, 558 bp, Homo sapiens
  Payload ID: 12582
  Gene Symbol: PGM3
  Gene Name: phosphoglucomutase 3
  ENST ID: ENST00000503094
  CDS Start-End: 217-558
gcggttctgaggactgggtttgggtgcagacgttgttgcttgggcgcttctccgctgcgtgtaggtgaagggggcttcctgaccgaggtaagccgggccccgaggctcggagttgagaagggagactaccggtcggcaagggctcggtgggagcgggacagttgagagtggaccaatttaagtgtgcccggcgtccaggatagtcctggagctaaaatgggaggagagtggggacaatctgctatctgccctgagtctgcccaggagtggacataccaagttggacaacatcttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcc

SEQ ID NO: 165552 - DNA, 753 bp, Homo sapiens
  Payload ID: 12582
  Gene Symbol: PGM3
  Gene Name: phosphoglucomutase 3
  ENST ID: ENST00000509219
  CDS Start-End: 1-594
gaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagggtcaagacttgtggtctggatttttattatttggcctcttcacatactccttaaagtgtgtgcaaagccagggcaaagtacagtgagtgcgctgaatagggaatcaggaggagacatttggcagctttcctgcagaagcttaagccatctcagagtctaatgaatatccatgatggatgaggagatggcaacagaggcattagtacttacttactgttaggccaattgtggattaaagttttattgaattttttcagttgtggaatgatagctatttttataatctgaattgattaaaaacttaccttatttagaagaa

SEQ ID NO: 165553 - DNA, 561 bp, Homo sapiens
  Payload ID: 12582
  Gene Symbol: PGM3
  Gene Name: phosphoglucomutase 3
  ENST ID: ENST00000505470
  CDS Start-End: 80-295
ggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctg

SEQ ID NO: 165554 - DNA, 640 bp, Homo sapiens
  Payload ID: 12582
  Gene Symbol: PGM3
  Gene Name: phosphoglucomutase 3
  ENST ID: ENST00000508748
  CDS Start-End: 171-640
gagccggaagccacgcagggccacgtctgcggttctgaggactgggtttgggtgcagacgttgttgcttgggcgcttctccgctgcgtgtaggtgaagggggcttcctgaccgagttgagagtggaccaatttaagtgtgcccggcgtccaggatagtcctggagctaaaatgggaggagagtggggacaatctgctatctgccctgagtctgcccaggagtggacataccaagttggacaacatcttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagatac

SEQ ID NO: 165555 - DNA, 6107 bp, Homo sapiens
  Payload ID: 12582
  Gene Symbol: PGM3
  Gene Name: phosphoglucomutase 3
  Uniprot ID: O95394
  ENST ID: ENST00000513973
  CDS Start-End: 118-1746
gagccggaagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaa

SEQ ID NO: 165556 - DNA, 556 bp, Homo sapiens
  Payload ID: 12582
  Gene Symbol: PGM3
  Gene Name: phosphoglucomutase 3
  ENST ID: ENST00000507554
  CDS Start-End: 117-556
gactcgcggaccgcccccccccaacaccgcggtggccttttcgcttgggccgcattccagggctccggacgtttacgattcactggcctctgccccgagggacccaggataaggacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttct

SEQ ID NO: 165557 - DNA, 1971 bp, Homo sapiens
  Payload ID: 12582
  Gene Symbol: PGM3
  Gene Name: phosphoglucomutase 3
  Uniprot ID: O95394
  ENST ID: ENST00000506587
  CDS Start-End: 148-1860
aacaccgcggtggccttttcgcttgggccgcattccagggctccggacgtttacgattcactggcctctgccccgagggacccaggataaggttgagagtggaccaatttaagtgtgcccggcgtccaggatagtcctggagctaaaatgggaggagagtggggacaatctgctatctgccctgagtctgcccaggagtggacataccaagttggacaacatcttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcct

SEQ ID NO: 165558 - DNA, 750 bp, Homo sapiens
  Payload ID: 12582
  Gene Symbol: PGM3
  Gene Name: phosphoglucomutase 3
  ENST ID: ENST00000510258
  CDS Start-End: 233-750
gttgttgcttgggcgcttctccgctgcgtgtaggtgaagggggcttcctgaccgagttgagagtggaccaatttaagtgtgcccggcgtccaggatagtcctggagctaaaatgggaggagagtggggacaatctgctatctgccctgagtctgcccaggagtggacataccaagttggacaacatcttgtaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgt

SEQ ID NO: 165559 - DNA, 143 bp, Homo sapiens
  Payload ID: 12582
  Gene Symbol: PGM3
  Gene Name: phosphoglucomutase 3
  ENST ID: ENST00000605602
  CDS Start-End: 1-36
gatgcctttgtagttattggtagagataccaggtgatgataagagttactggtaaaaaaaaaaacctttgggaacgtgatataaacgattgtatcagttttaatccaagacaaatggaaagaagtaaagtggaactaccctga

SEQ ID NO: 165560 - DNA, 5905 bp, Homo sapiens
  Payload ID: 12582
  Gene Symbol: PGM3
  Gene Name: phosphoglucomutase 3
  ENST ID: ENST00000616566
  CDS Start-End: 155-1480
gagccggaagccacgcagggccacgtctgcggttctgaggactgggtttgggtgcagacgttgttgcttgggcgcttctccgctgcgtgtaggtgaagggggcttcctgaccgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagtaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaa

SEQ ID NO: 165561 - DNA, 1782 bp, Homo sapiens
  Payload ID: 12583
  Gene Symbol: PGM5
  Gene Name: phosphoglucomutase 5
  Uniprot ID: Q15124
  ENST ID: ENST00000396392
  CDS Start-End: 230-1393
ggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactgtttagatcgtctctattggaacatctttaagttcactgattctttccttagctgtgtccaatctgctgatgagcctgttgaaggaattcttcttctccgatactgtgtgttttttttttttttttagcatttctctttgactcttttaaaatagtttttagttctctgaaattccccatctgtttatgtaattgtttatctttttcattagatcatttaacatattagacatggttgttttaaacaccctgtctgatagttccaatctctggttcatctctgactttggttcagctgattgctttatctcttgacaatggtttgggttttcctgttttttgtagatctcataaatttttattgaatgctgaataatatgtggataagaacagta

SEQ ID NO: 165562 - DNA, 3338 bp, Homo sapiens
  Payload ID: 12583
  Gene Symbol: PGM5
  Gene Name: phosphoglucomutase 5
  Uniprot ID: Q15124
  ENST ID: ENST00000396396
  CDS Start-End: 230-1933
ggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactggctctgaccacctccgagagaaggatggcctgtgggctgtcttggtctggctctccattattgctgcccggaagcagagtgtggaggaaattgtccgagatcactgggccaaatttggccgccactactattgcaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacatttagtggccaataaaaaagaaattcctaatttcaacctta

SEQ ID NO: 165563 - DNA, 616 bp, Homo sapiens
  Payload ID: 12583
  Gene Symbol: PGM5
  Gene Name: phosphoglucomutase 5
  ENST ID: ENST00000431583
  CDS Start-End: 1-616
gagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttg

SEQ ID NO: 165564 - DNA, 1885 bp, Homo sapiens
  Payload ID: 12584
  Gene Symbol: PGD
  Gene Name: phosphogluconate dehydrogenase
  Uniprot ID: P52209
  ENST ID: ENST00000270776
  CDS Start-End: 39-1490
gcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactga

SEQ ID NO: 165565 - DNA, 508 bp, Homo sapiens
  Payload ID: 12584
  Gene Symbol: PGD
  Gene Name: phosphogluconate dehydrogenase
  ENST ID: ENST00000477958
  CDS Start-End: 46-237
gtcctccgcgcgtcgccgctcttcggttctgctctgtccgccgccatggcccaagctgacatcgcgctgatcggattggccgtcatgggccagaacttaattctgaacatgaatgaccacggctttgtggacttttgtccttctaggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagc

SEQ ID NO: 165566 - DNA, 680 bp, Homo sapiens
  Payload ID: 12584
  Gene Symbol: PGD
  Gene Name: phosphogluconate dehydrogenase
  ENST ID: ENST00000483936
  CDS Start-End: 7-680
gccgccatggcccaagctgacatcgcgctgatcggattggccgtcatgggccagaacttaattctgaacatgaatgaccacggctttgtggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaag

SEQ ID NO: 165567 - DNA, 806 bp, Homo sapiens
  Payload ID: 12584
  Gene Symbol: PGD
  Gene Name: phosphogluconate dehydrogenase
  ENST ID: ENST00000491493
  CDS Start-End: 192-806
cgagtgcgcacaggactgaacgagcacgcccggtccctgctccggagcggaggacacgacgcggacccgcacggtgcaccgcagtgacctgaggaaggagcgacgggcgctcgcgccaaaggcgtccgagtgcctggtaaactgtaaagcgcggtcctgcagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccag

SEQ ID NO: 165568 - DNA, 642 bp, Homo sapiens
  Payload ID: 12584
  Gene Symbol: PGD
  Gene Name: phosphogluconate dehydrogenase
  ENST ID: ENST00000465632
  CDS Start-End: 163-642
gggggcccgcgggaggcgcggaggaaagtgcagactcccagtcacggccaaatgtggaaggaccggacccctgggttgcagcgcgtcgagcggtgctgactctttcctttgttctgtttctgcctctctagagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgg

SEQ ID NO: 165569 - DNA, 767 bp, Homo sapiens
  Payload ID: 12584
  Gene Symbol: PGD
  Gene Name: phosphogluconate dehydrogenase
  ENST ID: ENST00000460189
  CDS Start-End: 1-767
tgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattgagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattg

SEQ ID NO: 165570 - DNA, 3180 bp, Homo sapiens
  Payload ID: 12585
  Gene Symbol: PHGDH
  Gene Name: phosphoglycerate dehydrogenase
  ENST ID: ENST00000369407
  CDS Start-End: 1508-3007
attctatgctgcagcctaagcatcattcctcttctcttcttagtggagataaaattacccactgctctccttacatttactttgtccatatttgctcctatgctctaggctcgtgcacaacaaacacagtgtgggcccttaccctagaagccaacttctcatgacctttctctatctccagaatccatgcagtgggaatgaaggtaaaagaaggttttcatgggatccagctgagagctctacggggaaaatggatctgaggagccatgtgctccatctcttttattttacaggtagagactaggggtatagagtgaggtgaattaccgcagtgacccacacattgttggcagacctaggattagaactctgtcttcctggttcccagcttggtgcttttgaaagcatacttgctgctttcttaccggcctggtgtctgccactttgggacagagtgtggacttgctcacctgccccatttcttagggattctcattctgtgtttgagcaagaatattcttattctggaaagaaccacataccacaggattctgggtgagcataaggaagattgtcttggggatctgacttagctcacgtatagtggctatgatgaattcagtgtcttattttttgcatatgtatatttttagtctaatattgcctgggtgtctgagcaagtctagatgaatttaattgctctcatttttcccctgcccctcttcctttggtctctcttttaggaaatgtttttctttcaacattcgtttcattcattatttactcattcggccaaccaacatttattgagtgccttccctgtatcagggacaggggcttacaaagtagaatttgatcccacctctgccctcagtagctcagtgtctaatggaggtagtgatgttcattaagcgtcgccagatactgtgctaggtgctgtgcctgttctctctcgcttgttcctcacacacttgagaaggccgaagctgattcatagcttggaaggcaggggccttggatttgaacccaggcctgaccaatggcagaacctatcagatgtgtggacagatgacattgcctttctttctttggatatatcaaaatcagccagcaggcaggaactcccattttgagcaagcaatgtgcaggaatgatagggtatacagagaggaacaggagatggcccctgacttccagcatgtgtctgatggacatccaggctgcaggcatcatggtgctgtctagagagatgagccaggtgcccagagcccatgggccaatgctgccctttcttgagcatgccaaacaaagcggttggtgtgttagaggcacagtctcctccactctaagtaaaaatcagcatgagtcctagcccacatttccctagtgagtataccaaagatatctatgaactggcagtcatcagtgacttcctaaggttccggaaatgcatctcttactcaggagtaagcaatgatgtgcctgcggctttacgagttctcacagaatgactttctggacccaaatgttttttctgcttcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctaccccc

SEQ ID NO: 165571 - DNA, 1913 bp, Homo sapiens
  Payload ID: 12585
  Gene Symbol: PHGDH
  Gene Name: phosphoglycerate dehydrogenase
  Uniprot ID: O43175
  ENST ID: ENST00000369409
  CDS Start-End: 137-1738
gaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaa

SEQ ID NO: 165572 - DNA, 4887 bp, Homo sapiens
  Payload ID: 12586
  Gene Symbol: PGK1
  Gene Name: phosphoglycerate kinase 1
  Uniprot ID: P00558
  ENST ID: ENST00000373316
  CDS Start-End: 168-1421
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggaaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggcgggcagatcacctgtcaggagtttgggaccagcctggccaacatggtgaaaccccgtttctaccaaaaatacaaaaattagccgggcgtggtggcgtgtgccactgtagtcccagctattcagaaggctgaggcaggagaatcacttgaacccgggaggtggaggttgcagtgagctgagatcacgctactgcattcctgcttgggcgacagagtgagactctgcctcaaaacaaaaaccccacaaaacagtataaggatgtgctttctaatttggaattatgaattattggtaaaatattgcaaaggtgtatgctttaagttgtaaattcacctttaaccctagactatatatgtgtgtttatatgcagaaaaaaataattcccatgtcgtaagtgaacaatttggttctttagctcagtgttttcctgttttcttcatttccaaaatttccctctagcacaggggtttacacatgatcaaaaaggagtatacaatgaagacaccttcctcagtcccctacctaccagtttccctccccagaagcaacctctggaagaccagtttctttcaatctaaggctatttaatatacattaagaggccgggcgcagtggctcacgcctgtaatcccaacaacactttgggaggcccaggcaggcgggtcatgaggtcaggagattgagaccatcctggctaacacggtgaaaccctgtctctactaaaaatacaaaaaattagctgggcgtgatggtgggcgcctgtagtcccagctactcgggaggctgaggcaggagaatggcgtgaacctgggaagcggagctcgcagtgagccgagatcacgccactgcactccagcctgggcaacagtgagactctgcataaagagcatacccatgtgtgtacctatctatctatctatctatctatctatctatctatctatctgtatatagatatattaaaatgtaaatggtggcat

SEQ ID NO: 165573 - DNA, 1657 bp, Homo sapiens
  Payload ID: 12587
  Gene Symbol: PGK2
  Gene Name: phosphoglycerate kinase 2
  Uniprot ID: P07205
  ENST ID: ENST00000304801
  CDS Start-End: 121-1374
aagaaaggggcgggacaagggcaaaggcgttagaagtcaccaccgacccagcccctcaacagcaagttggttcttcagcattaagatccaggtgtcagcctatgtctttatattgtcaagatgtctctttctaagaagttgactttagacaaactggatgttagagggaagcgagtcatcatgagagtagacttcaatgttcccatgaagaagaaccagattacaaacaaccagaggatcaaggcttccatcccaagcatcaagtactgcctggacaatggagccaaggcagtagttcttatgagtcatctaggtcggcctgatggtgttcccatgcctgacaaatattccttagcacctgttgctgttgagctcaaatccttgctgggcaaggatgttctgttcctgaaggactgtgtaggcgcagaagtggagaaagcctgtgccaacccagctcctggttcagtcatcctgctggagaacctgcgctttcatgtggaggaagaagggaagggccaagatccctctggaaagaagattaaagctgagccagataaaatagaagccttccgagcatcactttccaagctaggggacgtctatgtcaatgatgcttttggcactgcacaccgcgctcatagttccatggtgggagtgaatctgccccataaagcatccggattcttgatgaagaaggaactagattactttgctaaagccttggaaaacccagtgagaccctttctggctatacttggtggagccaaagtggcagacaagatccaacttatcaaaaatatgctggacaaagtcaatgagatgattattggtggtggaatggcttataccttccttaaggtactcaacaacatggagattggtgcttccctgtttgatgaagagggagccaagatcgttaaagatatcatggccaaagcacaaaagaatggtgtaaggattacttttcctgttgattttgttactggggacaagtttgacgagaacgctcaggttggaaaagccactgtagcatctggcatatctcctggctggatgggtttggactgtggtcctgagagcaacaagaatcatgctcaagttgtggctcaagcaaggctaattgtttggaatgggccgttaggagtatttgaatgggatgcctttgctaagggaaccaaagccctcatggatgaaattgtgaaagccacttccaagggctgcatcactgttatagggggtggagacactgctacttgctgtgccaaatggaacactgaagataaagtcagccatgtcagcactggaggcggtgccagtctagagcttctggaaggtaaaatccttcctggagtagaggccctcagcaacatgtagttaatatagtgttacttccttctgttttctgtccatggcccttaagtcagcttaatgcttttacatctcgatgtgacttttgttaaaatctactcctagatcaagacctatgtaatggacaagcagcaggccatcaggaactcttaatatcagcacagcaattcattttagtttggtcacgcatttgcctgttcaagttctcatttgaacttcaccattgtgctatctagggaggacatattcttaagttgcctattaaagaaagtgagctgaagaaactgaa

SEQ ID NO: 165574 - DNA, 1830 bp, Homo sapiens
  Payload ID: 12588
  Gene Symbol: PGAM1
  Gene Name: phosphoglycerate mutase 1 (brain)
  Uniprot ID: P18669
  ENST ID: ENST00000334828
  CDS Start-End: 149-913
agcggtccagagcgagtggaaagatttgggcgagaacttgcgcgggagccggactgagcggtgcgagcgcgcaggcgcggccgacggggcgggctgctactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaata

SEQ ID NO: 165575 - DNA, 857 bp, Homo sapiens
  Payload ID: 12589
  Gene Symbol: PGAM2
  Gene Name: phosphoglycerate mutase 2 (muscle)
  Uniprot ID: P15259
  ENST ID: ENST00000297283
  CDS Start-End: 59-820
gggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 165576 - DNA, 765 bp, Homo sapiens
  Payload ID: 12590
  Gene Symbol: PGAM4
  Gene Name: phosphoglycerate mutase family member 4
  Uniprot ID: Q8N0Y7
  ENST ID: ENST00000458128
  CDS Start-End: 1-765
atggccgcctacaaactggtgctgatccggcacggcgagagcacatggaacctggagaaccgcttcagctgctggtacgacgccgatctgagcccggcgggccacgaggaggcgaagcgcggcgggcaggcgctacgagatgctggctatgagtttgacatctgcctcacctcagtgcagaagagagtgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctatgagagtccgaaggatactattgccagagctctgcccttctggaatgaagaaatagttccccagatcaaggaggggaaacgtgtactgattgcagcccatggcaacagcctccagggcattgccaagcatgtggagggtctctctgaagaggctatcatggagctgaacctgccgactggtattcccatcgtctatgaattggacaagaacttgaagcctatcaagcccatgcagtttctgggggatgaagagacggtgtgcaaagccatagaagctgtggctgcccagggcaaggccaagaagtga

SEQ ID NO: 165577 - DNA, 2727 bp, Homo sapiens
  Payload ID: 12591
  Gene Symbol: PGP
  Gene Name: phosphoglycolate phosphatase
  Uniprot ID: A6NDG6
  ENST ID: ENST00000333503
  CDS Start-End: 31-996
ccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccttacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 165578 - DNA, 905 bp, Homo sapiens
  Payload ID: 12591
  Gene Symbol: PGP
  Gene Name: phosphoglycolate phosphatase
  ENST ID: ENST00000562001
  CDS Start-End: 1-172
catcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgg

SEQ ID NO: 165579 - DNA, 890 bp, Homo sapiens
  Payload ID: 12592
  Gene Symbol: PHPT1
  Gene Name: phosphohistidine phosphatase 1
  Uniprot ID: Q9NRX4
  ENST ID: ENST00000247665
  CDS Start-End: 338-715
ctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 165580 - DNA, 985 bp, Homo sapiens
  Payload ID: 12592
  Gene Symbol: PHPT1
  Gene Name: phosphohistidine phosphatase 1
  Uniprot ID: Q9NRX4
  ENST ID: ENST00000371661
  CDS Start-End: 378-752
ggccgggaacgcccctggaccggaataatttccagggggcaagagctttcgaaccaacctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatgatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 165581 - DNA, 9901 bp, Homo sapiens
  Payload ID: 12593
  Gene Symbol: PIKFYVE
  Gene Name: phosphoinositide kinase, FYVE finger containing
  Uniprot ID: Q9Y2I7
  ENST ID: ENST00000264380
  CDS Start-End: 159-6455
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaagagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgagttcttgtattaaaaaccccaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaattgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagcagccagagactttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggccaatcaggaagcaaaaatgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacgggcaaggaggggaccgagaatcaaggcgttgagcctcaagatgaagtagatggaggagatacacaaaagaagcaactcataaatcctcatgtggaacttcaattttcagatgctaatgccaagttttactgtcggctctactatgcgggagagtttcataagatgcgtgaagtgattctggacagcagtgaagaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtggctgtttagactgtccgtaatggaatggtaaaactccatgaatttgcactttggtttttgatacctgtggagctgtctgtaggttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccggttaaacacgtgggcatttattgttttattgaggaatttgacttaaactgggaatcctgtcatgttgtttatctttccagcttgcctgtttttgagtatgtttgatgtttttaaaattttgtcttctctgtggaagacaggaggctacagcaattaactttaagcctccttttagagatatttttaaaacttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgacgaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgtttttggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactcca

SEQ ID NO: 165582 - DNA, 1640 bp, Homo sapiens
  Payload ID: 12593
  Gene Symbol: PIKFYVE
  Gene Name: phosphoinositide kinase, FYVE finger containing
  Uniprot ID: Q9Y2I7
  ENST ID: ENST00000308862
  CDS Start-End: 148-1536
gcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacaacagtttgcaacatccccaggagaacacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggt

SEQ ID NO: 165583 - DNA, 2039 bp, Homo sapiens
  Payload ID: 12593
  Gene Symbol: PIKFYVE
  Gene Name: phosphoinositide kinase, FYVE finger containing
  Uniprot ID: Q9Y2I7
  ENST ID: ENST00000392202
  CDS Start-End: 159-1514
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggtgtgggttttgttctaccctttctcatttctcccacacctcctccccataccttttttggttgattccttttatttcttgttttctccctcagcaccaccatgcccagtgtaaagcttgtagtctttaaaaggaactacatctgactgctcttcccataatgtgcaacttccaaggtggcatttctttgcatttataacatggatgttctgctctattcttttctctttcttcatttaacattttaaagcctatttgcctttgccgttacccagtaacataatatttcactaaacccattaagatgcttgaactagattgggggaaaatcattcacacattccaaaatatctccataataattcataatgcttattatgtatattctatatttattaaaacaatttcttctctaatgtaaaa

SEQ ID NO: 165584 - DNA, 1898 bp, Homo sapiens
  Payload ID: 12593
  Gene Symbol: PIKFYVE
  Gene Name: phosphoinositide kinase, FYVE finger containing
  Uniprot ID: Q9Y2I7
  ENST ID: ENST00000407449
  CDS Start-End: 148-1794
gcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggt

SEQ ID NO: 165585 - DNA, 4214 bp, Homo sapiens
  Payload ID: 12593
  Gene Symbol: PIKFYVE
  Gene Name: phosphoinositide kinase, FYVE finger containing
  ENST ID: ENST00000452564
  CDS Start-End: 63-4214
gaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgagttcttgtattaaaaaccccaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaattgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagcagccagagactttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggccaatcaggaagcaaaaatgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagt

SEQ ID NO: 165586 - DNA, 3282 bp, Homo sapiens
  Payload ID: 12593
  Gene Symbol: PIKFYVE
  Gene Name: phosphoinositide kinase, FYVE finger containing
  ENST ID: ENST00000443896
  CDS Start-End: 159-635
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaagagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgagttcttgtattaaaaaccccaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaattgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagcagccagagactttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatgga

SEQ ID NO: 165587 - DNA, 792 bp, Homo sapiens
  Payload ID: 12593
  Gene Symbol: PIKFYVE
  Gene Name: phosphoinositide kinase, FYVE finger containing
  ENST ID: ENST00000422495
  CDS Start-End: 69-792
gccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagcagacaacagtttgcaacatccccaggagaacacagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattg

SEQ ID NO: 165588 - DNA, 4803 bp, Homo sapiens
  Payload ID: 12594
  Gene Symbol: PIK3AP1
  Gene Name: phosphoinositide-3-kinase adaptor protein 1
  Uniprot ID: Q6ZUJ8
  ENST ID: ENST00000339364
  CDS Start-End: 121-2538
agagcggcggccggtcccgcgcggagcccggcgcccctccagcccgagccaggacgccgccggccccggtcccggccccgggcacgcagcgagccagggatgtgagcggcgccccgcggcatggcagcctcaggggtgcccagaggatgcgacatcctcatcgtctacagcccggatgccgaggaatggtgccagtacctgcagaccctgttcctgtccagtcggcaggtccgcagccagaagatactgactcacaggctgggccccgaggcctccttctcggcagaggacctaagccttttcctcagcacccgctgtgtcgtggtgctgctgtccgcggagctggtgcagcacttccacaagcccgccttgctgcccctgctgcagagagctttccatcctccgcaccgcgtggtcaggctgctctgcggcgtgcgggacagcgaggagttcctagacttctttccagattgggcccattggcaggagctcacctgtgacgatgagccagagacctacgtggcagctgtgaaaaaagccatttccgaagattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacctggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatcaaaaatatttgaaaaaaaatctacaaagtttcaaaaagcaaaacttgaatttgctgcatgccaagaagtatgttgaattcatgtaaatgaagtgatgtgtaggcattgtattagatattataagaaatctagaaatgatttaaagcatacaggaggatgtgcataggttatatgcaaatactatgctattttatatatgggacttgagcatttgtggattttgatactgggggatcctggaaccaatcccccatggataccaaagtacgactgtagttatctattttttacatacttattattaccaccatgctcagtaagtccatttttgcatggaatatggagccttaaaacatgtcatgaatttggagtccctggcacataaatctaccttcaaatcagaggtccttaatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcgtaacatggtaaagcctattaccagccaatgttgttagcatctttgtatgcacatcactgtttgtgcaatatatgaatattttgttgcattgtattcttatataaaaataagtagaaaacataaaattgaaattgctgatgagaa

SEQ ID NO: 165589 - DNA, 1766 bp, Homo sapiens
  Payload ID: 12594
  Gene Symbol: PIK3AP1
  Gene Name: phosphoinositide-3-kinase adaptor protein 1
  Uniprot ID: Q6ZUJ8
  ENST ID: ENST00000371109
  CDS Start-End: 183-1397
aaatggctcctgattggtaaattgcatctggaactgggaggatctgtacaggaactagaaatacttgaaagggacagcattctttgggctttcctgagggcattgactctggcatacctctcatggtgaccctggaagctccgcctctggagttgctatgagagaaattgctcttgtaggacatgaggtttttcaccagcgtggcctgctatggatcttgtctctttgcatctgagttgctgatcagatgcaaggactggctcaaaggaagaccagctctcttcactgccctgctagcttgtgtcctttatctttgtgagtggactggtgccaagcatgtcccagggtcatcttatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacctggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgta

SEQ ID NO: 165590 - DNA, 3151 bp, Homo sapiens
  Payload ID: 12594
  Gene Symbol: PIK3AP1
  Gene Name: phosphoinositide-3-kinase adaptor protein 1
  Uniprot ID: Q6ZUJ8
  ENST ID: ENST00000371110
  CDS Start-End: 186-2069
ataatgctgcccaggctggtctcaaactcctgagctcaagcaatcctcccgactcggcttcccaaagcacttggattacagattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacctggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcacaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaactgaaaaagactagagggattagtacaaactcctcttatacagaaggcaaatctgaggttccacagaagtctggaaccaagactattcagttggttaaataaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatc

SEQ ID NO: 165591 - DNA, 2467 bp, Homo sapiens
  Payload ID: 12595
  Gene Symbol: PIK3IP1
  Gene Name: phosphoinositide-3-kinase interacting protein 1
  Uniprot ID: Q96FE7
  ENST ID: ENST00000215912
  CDS Start-End: 185-976
aaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagagggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacgggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaattaaaaaaaaaaaaagactcca

SEQ ID NO: 165592 - DNA, 999 bp, Homo sapiens
  Payload ID: 12595
  Gene Symbol: PIK3IP1
  Gene Name: phosphoinositide-3-kinase interacting protein 1
  Uniprot ID: Q96FE7
  ENST ID: ENST00000402249
  CDS Start-End: 136-840
gagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctgggctacgtgctgggcattaccatgatggtgatcatcattgccatcggagctggcatcatcttgggctactcctacaagaggtcagtagcttctcttctgggccctcttaggaggaggggaggaaggtacacaaagtcaaactttgtggctttcttacccaaaaggaagcaagatgttgaaaatcagctcaagatgtagagacttggtcctagtctttatctgctgaccttggacaaaccctttcctttggtgcctttacacctcacttaaaagccttgtgagggatgttcttgttccgcattttacaaatgaagaagcctctgtcagagacttgctcaaagtcacatagcctaggag

SEQ ID NO: 165593 - DNA, 578 bp, Homo sapiens
  Payload ID: 12595
  Gene Symbol: PIK3IP1
  Gene Name: phosphoinositide-3-kinase interacting protein 1
  ENST ID: ENST00000443175
  CDS Start-End: 145-578
agttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccaggccaggttcagctgtggaattcactcagggcagtccctgatgagagctgtttcccacctcatctccagagaccacctcccaggccctgccagccttcacgacagaaatccaggaagcgtctgaaggg

SEQ ID NO: 165594 - DNA, 2374 bp, Homo sapiens
  Payload ID: 12595
  Gene Symbol: PIK3IP1
  Gene Name: phosphoinositide-3-kinase interacting protein 1
  Uniprot ID: Q96FE7
  ENST ID: ENST00000441972
  CDS Start-End: 191-712
agctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagagcgggctggcctcggcccccgtgtcgggggccggcaatcacagttactgccgaaacccggacgaggacccgcgcgggccctggtgctacgtcagtggcgaggccggcgtccctgagaaacggccttgcgaggacctgcgctgtccagagaccacctcccaggccctgccagccttcacgacagaaatccaggaagcgtctgaagggccaggtgcagatgaggtgcaggtgttcgctcctgccaacgccctgcccgctcggagtgaggcggcagctgtgcagccagtgattgggatcagccagcgggtgcggatgaactccaaggagaaaaaggacctgggaactctggggggaaggatttgaaagaacagcatgatcagaaagtatgtgagagggagatgcagcgaatcactctgcccttgtctgccttcaccaaccccacctgtgagattgtggatgagaagactgtcgtggtccacaccagccagactccagttgaccctcaggagggcaccaccccccttatgggccaggccgggactcctggggcctgagcccccccagtgggcaggagcccatgcagacactggtgcaggacagcccaccctcctacagctaggaggaactaccactttgtgttctggttaaaaccctaccactcccccgcttttttggcgaatcctagtaagagtgacagaagcaggtggccctgtgggctgagggtaaggctgggtagggtcctaacagtgctccttgtccatcccttggagcagattttgtctgtggatggagacagtggcagctcccacagtgatgctgctgctaagggcttccaaacattgcctgcacccctggaactgaaccagggatagacggggagctcccccaggctcctctgtgctttactaagatggcctcagtctccactgtgggcttgagtggcatacactgttattcatggttaaggtaaagcaggtcaagggatggcattgaaaaaatatatttagtttttaaaatatttgggatggaactccctactgacctctgagaactggaaacgagtttgtacagaagtcagaactttgggttgggaatgagatctaggttgtggctgctggtatgcttcagcttgctggcaatgatgtgccttgacaaccgtgggccaggcctgggcccagggactcttcctgtttcataaggaaaggaagaattgcactgagcattccacttaggaagaggatagagaaggatctgctccgcctttggccacaggagcagaggcagacctgggatgccccagtttctcttcagggatggatagtgacctgtcttcattttgcacaggtaagagagtagttagctaacctatgggaattatactgtggggccttgtgagctgcttctaagaggctaacctggaaactaagctcagaggcaaggtaataaagcacttcagggcttgctccccaagtgggcctgatttagcaggtggtcctgcgggcgtccaggtcagcaccttcctgtagggcactggggctagggtcacagcccctaactcataaagcaatcaaagaaccattagaaagggctcattaagccttttggacacaggaccccagagaggaaaaagtgacttgcccaaggtcgtaagcaagctactggcatggcaagagcccagcttcctgacggagcgcaacatttctccactgcactgtgctagcagctcagcagggcctctaacctgtgatgtcacactcaagaggccttggcagctcctagccatagagcttcctttccagaacccttccactgcccaatgtggagacgggttagtggggctttctatggagccatctgctttggggacctagacctcaggtggtctcttggtgttagtgatgctggagaagagaatattactggtttctacttttctataaaggcatttctctatatacatgttttatatacctcattctgacacctgcatatagtgtgggaaattgctctgcatttgacttaatt

SEQ ID NO: 165595 - DNA, 2625 bp, Homo sapiens
  Payload ID: 12596
  Gene Symbol: PIK3R1
  Gene Name: phosphoinositide-3-kinase, regulatory subunit 1 (alpha)
  Uniprot ID: P27986
  ENST ID: ENST00000320694
  CDS Start-End: 369-1643
atctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaa

SEQ ID NO: 165596 - DNA, 2439 bp, Homo sapiens
  Payload ID: 12596
  Gene Symbol: PIK3R1
  Gene Name: phosphoinositide-3-kinase, regulatory subunit 1 (alpha)
  Uniprot ID: P27986
  ENST ID: ENST00000336483
  CDS Start-End: 93-1457
tataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaa

SEQ ID NO: 165597 - DNA, 7011 bp, Homo sapiens
  Payload ID: 12596
  Gene Symbol: PIK3R1
  Gene Name: phosphoinositide-3-kinase, regulatory subunit 1 (alpha)
  Uniprot ID: P27986
  ENST ID: ENST00000521381
  CDS Start-End: 617-2791
gcgccgggcgctggagctgcgggcgcacggagaggagtcgccagcagctggagcggagttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 165598 - DNA, 395 bp, Homo sapiens
  Payload ID: 12596
  Gene Symbol: PIK3R1
  Gene Name: phosphoinositide-3-kinase, regulatory subunit 1 (alpha)
  ENST ID: ENST00000520675
  CDS Start-End: 1-395
acagcaaaagaacctcatcagaaccgcaggctggaaagagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcc

SEQ ID NO: 165599 - DNA, 567 bp, Homo sapiens
  Payload ID: 12596
  Gene Symbol: PIK3R1
  Gene Name: phosphoinositide-3-kinase, regulatory subunit 1 (alpha)
  ENST ID: ENST00000519025
  CDS Start-End: 1-567
aaagacgaccagaaaaagtcactgagcactggagaactggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggc

SEQ ID NO: 165600 - DNA, 3891 bp, Homo sapiens
  Payload ID: 12596
  Gene Symbol: PIK3R1
  Gene Name: phosphoinositide-3-kinase, regulatory subunit 1 (alpha)
  Uniprot ID: P27986
  ENST ID: ENST00000521657
  CDS Start-End: 565-2739
agttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaa

SEQ ID NO: 165601 - DNA, 705 bp, Homo sapiens
  Payload ID: 12596
  Gene Symbol: PIK3R1
  Gene Name: phosphoinositide-3-kinase, regulatory subunit 1 (alpha)
  ENST ID: ENST00000522084
  CDS Start-End: 398-705
acacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaag

SEQ ID NO: 165602 - DNA, 2473 bp, Homo sapiens
  Payload ID: 12596
  Gene Symbol: PIK3R1
  Gene Name: phosphoinositide-3-kinase, regulatory subunit 1 (alpha)
  Uniprot ID: P27986
  ENST ID: ENST00000523872
  CDS Start-End: 233-1318
attattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagat

SEQ ID NO: 165603 - DNA, 552 bp, Homo sapiens
  Payload ID: 12596
  Gene Symbol: PIK3R1
  Gene Name: phosphoinositide-3-kinase, regulatory subunit 1 (alpha)
  ENST ID: ENST00000523807
  CDS Start-End: 201-552
acacttgaagctgctcaatactggaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatg

SEQ ID NO: 165604 - DNA, 945 bp, Homo sapiens
  Payload ID: 12596
  Gene Symbol: PIK3R1
  Gene Name: phosphoinositide-3-kinase, regulatory subunit 1 (alpha)
  ENST ID: ENST00000517698
  CDS Start-End: 48-164
ggactcttttcttataactgagctcagccaaggaaactcttgcacaaatgtacaatactgtttggaatatggaagacctggatttagaatatgccaagacagatataaattgtggcacagacttgatgttttatatagaaatggacccaccagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactga

SEQ ID NO: 165605 - DNA, 540 bp, Homo sapiens
  Payload ID: 12596
  Gene Symbol: PIK3R1
  Gene Name: phosphoinositide-3-kinase, regulatory subunit 1 (alpha)
  ENST ID: ENST00000521409
  CDS Start-End: 128-540
ttcattgtcggatacaggcatttcaaagggaaaccgttgaaatgcataacctgcaaaggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagaccca

SEQ ID NO: 165606 - DNA, 4033 bp, Homo sapiens
  Payload ID: 12597
  Gene Symbol: PIK3R2
  Gene Name: phosphoinositide-3-kinase, regulatory subunit 2 (beta)
  Uniprot ID: O00459
  ENST ID: ENST00000222254
  CDS Start-End: 601-2787
ccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtcgtgggtga

SEQ ID NO: 165607 - DNA, 3273 bp, Homo sapiens
  Payload ID: 12597
  Gene Symbol: PIK3R2
  Gene Name: phosphoinositide-3-kinase, regulatory subunit 2 (beta)
  ENST ID: ENST00000426902
  CDS Start-End: 259-1704
gacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccagggccttttggggagtcccaggaggtgctgagctgcgccccctcctccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggt

SEQ ID NO: 165608 - DNA, 588 bp, Homo sapiens
  Payload ID: 12597
  Gene Symbol: PIK3R2
  Gene Name: phosphoinositide-3-kinase, regulatory subunit 2 (beta)
  ENST ID: ENST00000464016
  CDS Start-End: 1-373
tgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggatacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctc

SEQ ID NO: 165609 - DNA, 2187 bp, Homo sapiens
  Payload ID: 12597
  Gene Symbol: PIK3R2
  Gene Name: phosphoinositide-3-kinase, regulatory subunit 2 (beta)
  Uniprot ID: O00459
  ENST ID: ENST00000617130
  CDS Start-End: 1-2187
atggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctga

SEQ ID NO: 165610 - DNA, 1446 bp, Homo sapiens
  Payload ID: 12597
  Gene Symbol: PIK3R2
  Gene Name: phosphoinositide-3-kinase, regulatory subunit 2 (beta)
  ENST ID: ENST00000617642
  CDS Start-End: 1-1446
atggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccagggccttttggggagtcccaggaggtgctga

SEQ ID NO: 165611 - DNA, 5609 bp, Homo sapiens
  Payload ID: 12598
  Gene Symbol: PIK3R3
  Gene Name: phosphoinositide-3-kinase, regulatory subunit 3 (gamma)
  Uniprot ID: Q92569
  ENST ID: ENST00000262741
  CDS Start-End: 691-2076
gtggctggagtccgggcagagcttgagggcagttggtgcggtcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaa

SEQ ID NO: 165612 - DNA, 5019 bp, Homo sapiens
  Payload ID: 12598
  Gene Symbol: PIK3R3
  Gene Name: phosphoinositide-3-kinase, regulatory subunit 3 (gamma)
  Uniprot ID: Q92569
  ENST ID: ENST00000372006
  CDS Start-End: 101-1486
acagaatcccggtacatcgaggcgggacggcgtggaaggggcggtggtgatgcctgctgtcccccctcccggcgcggttgggtggcgcctcagcggcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaa

SEQ ID NO: 165613 - DNA, 1884 bp, Homo sapiens
  Payload ID: 12598
  Gene Symbol: PIK3R3
  Gene Name: phosphoinositide-3-kinase, regulatory subunit 3 (gamma)
  Uniprot ID: Q92569
  ENST ID: ENST00000423209
  CDS Start-End: 665-1873
gggcagttggtgcggtcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgg

SEQ ID NO: 165614 - DNA, 5174 bp, Homo sapiens
  Payload ID: 12598
  Gene Symbol: PIK3R3
  Gene Name: phosphoinositide-3-kinase, regulatory subunit 3 (gamma)
  Uniprot ID: Q92569
  ENST ID: ENST00000420542
  CDS Start-End: 258-1643
aaccggcctcagccaatcaccacccaccttgcctctcttccctcgccccactccctcctcgcctggctcgcgtgctcccggcactgactcctggagtgcggccagcgcccggatcgtaccattctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagt

SEQ ID NO: 165615 - DNA, 753 bp, Homo sapiens
  Payload ID: 12598
  Gene Symbol: PIK3R3
  Gene Name: phosphoinositide-3-kinase, regulatory subunit 3 (gamma)
  ENST ID: ENST00000425892
  CDS Start-End: 135-753
ctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatccc

SEQ ID NO: 165616 - DNA, 1553 bp, Homo sapiens
  Payload ID: 12599
  Gene Symbol:
  Gene Name: phosphoinositide-3-kinase, regulatory subunit 3 (gamma) [Source:EntrezGene
  Acc:8503]
  ENST ID: ENST00000540385
  CDS Start-End: 18-1541
agaagctccctgtgcccatggggccatctcggcttgtccgtggccctcggccccagggcatgcgttccccctaccgcaggccaggtatgggctggcccaggccccgatttcccaggatgttcaagtgtagccgcagaagatatcaacagggtctccgaggtcgaactgccagcagtgcagccatcaatcctgccaccagggccatgggtatcaacaacacccacactgacaccaccatagtgtggatcttcccacctcaagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtggg

SEQ ID NO: 165617 - DNA, 5015 bp, Homo sapiens
  Payload ID: 12600
  Gene Symbol: PIK3R4
  Gene Name: phosphoinositide-3-kinase, regulatory subunit 4
  Uniprot ID: Q99570
  ENST ID: ENST00000356763
  CDS Start-End: 559-4635
gaggtcagaccggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatgtcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgt

SEQ ID NO: 165618 - DNA, 579 bp, Homo sapiens
  Payload ID: 12600
  Gene Symbol: PIK3R4
  Gene Name: phosphoinositide-3-kinase, regulatory subunit 4
  ENST ID: ENST00000512430
  CDS Start-End: 200-579
cttctaacctccattgttgctgaagattatataattacagtctgattcttcttcctttttaggagacctatattttcatttctgtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagc

SEQ ID NO: 165619 - DNA, 563 bp, Homo sapiens
  Payload ID: 12600
  Gene Symbol: PIK3R4
  Gene Name: phosphoinositide-3-kinase, regulatory subunit 4
  ENST ID: ENST00000507330
  CDS Start-End: 177-563
aagtgctgcacacccatccagtgtgaaataggctttacttagtccttgcctgttggaagggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagctt

SEQ ID NO: 165620 - DNA, 817 bp, Homo sapiens
  Payload ID: 12600
  Gene Symbol: PIK3R4
  Gene Name: phosphoinositide-3-kinase, regulatory subunit 4
  ENST ID: ENST00000508273
  CDS Start-End: 239-817
tttctgtaagttcttaggatcttagcttttctgtggtgtccgagaatttcctgatgatttgccttgctgtgggtctttttaactttatcatgctgggtaggaagtgcaatgttctttcctaggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgtt

SEQ ID NO: 165621 - DNA, 4317 bp, Homo sapiens
  Payload ID: 12601
  Gene Symbol: PIK3R5
  Gene Name: phosphoinositide-3-kinase, regulatory subunit 5
  ENST ID: ENST00000269300
  CDS Start-End: 122-757
gctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtgccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcctatatttaa

SEQ ID NO: 165622 - DNA, 4495 bp, Homo sapiens
  Payload ID: 12601
  Gene Symbol: PIK3R5
  Gene Name: phosphoinositide-3-kinase, regulatory subunit 5
  Uniprot ID: Q8WYR1
  ENST ID: ENST00000447110
  CDS Start-End: 131-2773
tgggcagatgctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcctat

SEQ ID NO: 165623 - DNA, 628 bp, Homo sapiens
  Payload ID: 12601
  Gene Symbol: PIK3R5
  Gene Name: phosphoinositide-3-kinase, regulatory subunit 5
  ENST ID: ENST00000581895
  CDS Start-End: 495-628
aagcatattgagggagttgctgtggccttgtcatcaggaacacgctctctgccccatccctggaggtttggaaaacacagcctggaaattcagaaaaagtcctccgagtgattctgattttcccctcaggatcttcctgcccagcccactggggtctgaccactccctgggtacttggcgacacttcccactgcccagtgccctttccacctctctgctcccattcctgaccccttacttcccacacctctgtcccgttctgctgcaggggtgctctgtcctgccactcagatgtggccctccagatgccattcctaccctggaggcagctgtaaggcccctggtcctgtttccacagcacctgagctatagctgggctgggctgatcgcgctgcactgtgagcacctgttgtctttactggaccaggtgctctctgggaaaggagctcgacaagctgaccggcgtctgtcccccatgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgca

SEQ ID NO: 165624 - DNA, 3253 bp, Homo sapiens
  Payload ID: 12601
  Gene Symbol: PIK3R5
  Gene Name: phosphoinositide-3-kinase, regulatory subunit 5
  Uniprot ID: Q8WYR1
  ENST ID: ENST00000581552
  CDS Start-End: 68-2710
aagcttactcagcgcatctgctacagcattttatcttcccaagagccccatgaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcac

SEQ ID NO: 165625 - DNA, 2653 bp, Homo sapiens
  Payload ID: 12601
  Gene Symbol: PIK3R5
  Gene Name: phosphoinositide-3-kinase, regulatory subunit 5
  ENST ID: ENST00000584803
  CDS Start-End: 14-2653
gcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctag

SEQ ID NO: 165626 - DNA, 719 bp, Homo sapiens
  Payload ID: 12601
  Gene Symbol: PIK3R5
  Gene Name: phosphoinositide-3-kinase, regulatory subunit 5
  ENST ID: ENST00000585260
  CDS Start-End: 1-282
ggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcaggtaggaaaggggggtcctagggaggggagcagtttctgctcccaccaacccagaggcctggaaggagctggaaggatgggggcctgctctgatccctggcccctgccctgctgcacagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctg

SEQ ID NO: 165627 - DNA, 4339 bp, Homo sapiens
  Payload ID: 12601
  Gene Symbol: PIK3R5
  Gene Name: phosphoinositide-3-kinase, regulatory subunit 5
  Uniprot ID: Q8WYR1
  ENST ID: ENST00000611902
  CDS Start-End: 1135-2619
tgggcagatgctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcct

SEQ ID NO: 165628 - DNA, 4377 bp, Homo sapiens
  Payload ID: 12601
  Gene Symbol: PIK3R5
  Gene Name: phosphoinositide-3-kinase, regulatory subunit 5
  Uniprot ID: Q8WYR1
  ENST ID: ENST00000616147
  CDS Start-End: 1173-2657
tgggcagatgctgcggctcgccgcgcggctccagctggggcgcggtggtcccgacggtcacccgaatcgcagggagtcgccgctggagaggggctcggcgcccggcggggactgcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcct

SEQ ID NO: 165629 - DNA, 4318 bp, Homo sapiens
  Payload ID: 12601
  Gene Symbol: PIK3R5
  Gene Name: phosphoinositide-3-kinase, regulatory subunit 5
  Uniprot ID: Q8WYR1
  ENST ID: ENST00000623421
  CDS Start-End: 1114-2598
tgggcagatgctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtgccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcct

SEQ ID NO: 165630 - DNA, 3041 bp, Homo sapiens
  Payload ID: 12602
  Gene Symbol: PIK3R6
  Gene Name: phosphoinositide-3-kinase, regulatory subunit 6
  Uniprot ID: Q5UE93
  ENST ID: ENST00000619866
  CDS Start-End: 241-2505
tttgcagatctgaagagcacagtcaagaccacagacacccgtggaggctcccccaagacatctgcttctctgggactggggacctcgctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctcccatggagagctcagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggcggaaagccaggacctccggcatgtcatcattcccttgctgcacactgtaatgtacgtgctcaccaaggccacaggaatcacagaagagctctaccagagaatctatgccttttgcacaaggttactgaccctgcccaccccctactgcacagtcgccttggactgcgcgataaggctgaaaacggagatggctgtcccagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggccagccctcgccgcaccctggagcactatttccacgccgtggtggccgccttggagcagatggccagcgaggccagcccgagccgggagggacacgtagagaggctggaggagatttactgctcgctgctgggtcccgcggcggggcgctgcggtggtgaccttgtccaagagcggccaccaagcattcccctgcccagcccctacatcaccttccacttgtggaccggtgaggagcagctctggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatgcctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagatggcttttcacccaggaggagaggcgtggctgagggcccaggggcagagctctccctatgctaccagaaggccttgcttagccaccggccccgagaggtcaccgtttccctgcgggccactgggctgatcctgaaggccattccagccagcgacacagaagtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtgagcctgcagggacagcaggcccaggaggaaggatacactaccccaccaactccaaacactcacaccaacagccagagcaaggcccggctccacacggcagctttggccttgaccaggagccagcgagtgcctgggagcacagggagcctaccctggggactgtgatgaggaagggcccacatggaggtctacggatggcccaggcaatgctgtcgctgcttgagaacatacacaccaagcccagcttctcatacaaatgtctactccttcatttagcttcaattcccacttctcccactgtcctctcccacccaagctccccatccagcccttaaaaccagggttaaagctgctgtcttggccagagccctgtggcctaggggaaaattggaagcaaggaacagcaacagcaccacctccctcccaagtctcttcccttcccactctcaggccactgcccacctcactcagcccaggcaggtgtctctatcaggtgagagaaaaatgtcagactcaataaatgtacactgaagtctt

SEQ ID NO: 165631 - DNA, 3392 bp, Homo sapiens
  Payload ID: 12602
  Gene Symbol: PIK3R6
  Gene Name: phosphoinositide-3-kinase, regulatory subunit 6
  ENST ID: ENST00000611951
  CDS Start-End: 224-526
cacagtcaagaccacagacacccgtggaggctcccccaagacatctgcttctctgggactggggacctcgctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctcccatggagagctcagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggtgagttcctggacctcagggaggaagacggggatgaaaggaagagaggggccaattgggcaggggctcagtcctggcagcgctatatctcataagctttggttgcctgcatgatttttaccatatgcatctccctcctgtacttttacgtaagcagtattttctttacgtcgactctcattgttttacttgaataaacatctttcaaaaagaagcactataacgcgaccacaaatggaaaacccgcatcacttgtcagaaacagaaggcggaaagccaggacctccggcatgtcatcattcccttgctgcacactgtaatgtacgtgctcaccaaggccacaggaatcacagaagagctctaccagagaatctatgccttttgcacaaggttactgaccctgcccaccccctactgcacagtcgccttggactgcgcgataaggctgaaaacggagatggctgtcccaggataccggggagctcaaaagcctccacaccttctgtaggaaggtggagaatgggagtcagagacttgggggctgtttggccaaagtggtctggtttgcagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggccagccctcgccgcaccctggagcactatttccacgccgtggtggccgccttggagcagatggccagcgaggccagcccgagccgggagggacacgtagagaggctggaggagatttactgctcgctgctgggtcccgcggcggggcgctgcggtggtgaccttgtccaagagcggccaccaagcattcccctgcccagcccctacatcaccttccacttgtggaccggtgaggagcagctctggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatgcctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagatggcttttcacccaggaggagaggcgtggctgagggcccaggggcagagctctccctatgctaccagaaggccttgcttagccaccggccccgagaggtcaccgtttccctgcgggccactgggctgatcctgaaggccattccagccagcgacacagaagtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtgagcctgcagggacagcaggcccaggaggaaggatacactaccccaccaactccaaacactcacaccaacagccagagcaaggcccggctccacacggcagctttggccttgaccaggagccagcgagtgcctgggagcacagggagcctaccctggggactgtgatgaggaagggcccacatggaggtctacggatggcccaggcaatgctgtcgctgcttgagaacatacacaccaagcccagcttctcatacaaatgtctactccttcatttagcttcaattcccacttctcccactgtcctctcccacccaagctccccatccagcccttaaaaccagggttaaagctgctgtcttggccagagccctgtggcctaggggaaaattggaagcaaggaacagcaacagcaccacctccctcccaagtctcttcccttcccactctcaggccactgcccacctcactcagcccaggcaggtgtctctatcaggtgagagaaaaatgtcagactcaataaatgtacactgaagtctt

SEQ ID NO: 165632 - DNA, 2265 bp, Homo sapiens
  Payload ID: 12602
  Gene Symbol: PIK3R6
  Gene Name: phosphoinositide-3-kinase, regulatory subunit 6
  Uniprot ID: Q5UE93
  ENST ID: ENST00000614407
  CDS Start-End: 1-2265
atggagagctcagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggcggaaagccaggacctccggcatgtcatcattcccttgctgcacactgtaatgtacgtgctcaccaaggccacaggaatcacagaagagctctaccagagaatctatgccttttgcacaaggttactgaccctgcccaccccctactgcacagtcgccttggactgcgcgataaggctgaaaacggagatggctgtcccagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggccagccctcgccgcaccctggagcactatttccacgccgtggtggccgccttggagcagatggccagcgaggccagcccgagccgggagggacacgtagagaggctggaggagatttactgctcgctgctgggtcccgcggcggggcgctgcggtggtgaccttgtccaagagcggccaccaagcattcccctgcccagcccctacatcaccttccacttgtggaccggtgaggagcagctctggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatgcctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagatggcttttcacccaggaggagaggcgtggctgagggcccaggggcagagctctccctatgctaccagaaggccttgcttagccaccggccccgagaggtcaccgtttccctgcgggccactgggctgatcctgaaggccattccagccagcgacacagaagtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtga

SEQ ID NO: 165633 - DNA, 3291 bp, Homo sapiens
  Payload ID: 12602
  Gene Symbol: PIK3R6
  Gene Name: phosphoinositide-3-kinase, regulatory subunit 6
  ENST ID: ENST00000613555
  CDS Start-End: 241-543
tttgcagatctgaagagcacagtcaagaccacagacacccgtggaggctcccccaagacatctgcttctctgggactggggacctcgctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctcccatggagagctcagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggtgagttcctggacctcagggaggaagacggggatgaaaggaagagaggggccaattgggcaggggctcagtcctggcagcgctatatctcataagctttggttgcctgcatgatttttaccatatgcatctccctcctgtacttttacgtaagcagtattttctttacgtcgactctcattgttttacttgaataaacatctttcaaaaagaagcactataacgcgaccacaaatggaaaacccgcatcacttgtcagaaacagaaggcggaaagccaggacctccggcatgtcatcattcccttgctgcacactgtaatgccacaggaatcacagaagagctctaccagagaatctatgccttttgcacaaggttactgaccctgcccaccccctactgcacagtcgccttggactgcgcgataaggctgaaaacggagatggctgtcccagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggtgaccttgtccaagagcggccaccaagcattcccctgcccagcccctacatcaccttccacttgtggaccggtgaggagcagctctggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatgcctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagatggcttttcacccaggaggagaggcgtggctgagggcccaggggcagagctctccctatgctaccagaaggccttgcttagccaccggccccgagaggtcaccgtttccctgcgggccactgggctgatcctgaaggccattccagccagcgacacagaagtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagatgcctctgcatacactcagcctgcagcctcctgatccagtcccctctgcaggcacgggcccctcccacacaggctgacctgtggcatctgtgttccagttagctgacccttactggcttcccctcgggaggtgtgtttggattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtgagcctgcagggacagcaggcccaggaggaaggatacactaccccaccaactccaaacactcacaccaacagccagagcaaggcccggctccacacggcagctttggccttgaccaggagccagcgagtgcctgggagcacagggagcctaccctggggactgtgatgaggaagggcccacatggaggtctacggatggcccaggcaatgctgtcgctgcttgagaacatacacaccaagcccagcttctcatacaaatgtctactccttcatttagcttcaattcccacttctcccactgtcctctcccacccaagctccccatccagcccttaaaaccagggttaaagctgctgtcttggccagagccctgtggcctaggggaaaattggaagcaaggaacagcaacagcaccacctccctcccaagtctcttcccttcccactctcaggccactgcccacctcactcagcccaggcaggtgtctctatcaggtgagagaaaaatgtcagactcaataaatgtacactgaagtctttctgctttcatctc

SEQ ID NO: 165634 - DNA, 3810 bp, Homo sapiens
  Payload ID: 12603
  Gene Symbol: PIRT
  Gene Name: phosphoinositide-interacting regulator of transient receptor potential channels
  Uniprot ID: P0C851
  ENST ID: ENST00000580256
  CDS Start-End: 640-1053
agtgtagcctgagtcagccggagggtctgatccactctttggcaactcatccccaccaccatggccactacacacctccaccaacccagaaactccaggtcctctgatttctgagcctgggtcaggagaagctgccctgcccaggcaccaacggaacgcacgcctccatgaaacttgaagacagactgcagagaagcatcatgaatttttcacaagattcatctaattgtggctgagcagagctgagaaagccacagtccgaggacccatgccagcagctcacaaagagttaacccattaggccattgcctggtgagctcatccatccctgctggagcctgctcagttgctgggattcacaacacactgacttctggacgtggtcagggtggctttctctggctggcatggacttgagcagaaactcattgccggcttcctccttgcacgagcaccaagtgattcccaggtcccccatcctcccctgggacatcgaggacacacaaaaaccttgttcaccctccactgagagcggggctagagatggatgctgagtacaggaagggtgtgtgaggattcctttggctccactcttgtttccaactattgctggtcctaggcgcccagtcctgagcaaccatgacgatggagactctccccaaggttctagaggtcgatgagaagtctccagaagccaaggacctgctgcccagccagaccgccagctccctgtgcatcagctccaggagcgagtctgtctggaccaccacccccaggagtaactgggaaatctaccgcaagcccatcgttatcatgtcagtgggcggtgccatcctgcttttcggcgtggtcatcacctgcttggcctacaccttgaagctgagtgacaagagtctctccatcctcaaaatggtagggcctggcttcctgtccctgggactcatgatgctggtgtgcgggctggtgtgggtgcccatcatcaaaaagaaacagaagcacagacagaagtcgaatttcttacgcagcctcaagtccttcttcctgactcgctgatggtggtttccgcatctccctgccaccttgactgggagaagatctgatgaccaacatccgacatccctgtctcctctgtggggtgccataaaactgatccaggaaaatgctcttcctgaccctgtggggaagatagagcttggggctccaccctccatgcagccgggaatgttgccagatgtatccacttgatctctattctgactgatgcttccttggatcccggctgtggccttccctttggtcactctaaccccctgcccctgcatccaggcatcattcatccaactctctctgccaagtgcaatgcatgctgggaaattcttcgaaggtgggctatgcccaagggagaacctcatgtttacatatctgagtgccagagctggattcttcatttgcatacttctggaaccaaaactgacccacggaggtcctttacagaggagggagggatggctgagctctgacccattgggtttgacagccctagctcccttagcagactttcaagatcacaagtatcaaacattccaaagactgaacaatgaagggaggcctgggaaaaatactctccaagatggcacgtgcccctggacatgacaacatgactctaggggttagtcagctgaagaagtttagttcctaattatataatatttacatcagaggcagtggggtaggctaggggatgtcactgtttccgcttgaccttatctttctcattgaccactgtcttctctgaacttgatcattagccaaggacaaaatgcatgttgccctaatttctttcctacccctgcctctatctctgcatctagaacagctaaatggaaagatacagagggatcctgtaaggttgttttccctttcacgtccatcaagatcaaaattgagagaatcaagttccatatctgaatgatctgtaggtttctagagatggaattcacgtcagaaaattccaacttctgttatccctgcccccacccaccaaaaaagccaacatttattaagtgtcgcattctgggataagccctggctgggggcaagacacggtccctgatgtcttcttgcttcccgaggtgagagaggcagccaagccaactggcgaaatgtgggtgggtgtgggaacacaggcggtgtctaccctagacttgatagaggacggagaaattcctggaggccatgtcctccaacccaaaaacaaaaggaaagataagagttaccaaagaggggaaagaatggcattggaagcagcaggagctgctatgcgtgtgcaggagtagcttggggaaggagaagcatgatggaattaggaaactgcacggccatttgtctgacctcccagatgtttttacttcatccctctctttcccggcttcccacctcttcaccaagtgcctagcgcagcttctcctggaggcacattgagggcctcctggtgtctatggtagagacgggaagtgggtttccagagggcctggcaagcaaagagtccctgagaagtgcttctgtaactccctgtggcaaccaagaggcccgtaggtgaaagaacagaagcagtacctgtgagggagccagccacgctgccctaggccaaagacccctggagagcatttggtaatgaggtgtgagaggagagcatcctgcaccagaatcacccttgtcttgagctaattctcttcactcctcagccttgtggccttcccagtcaccatggccctccagatatccccatcctgcatggcagttccatatgcagagccagaatccatccttgttccttctgcattgtgagaaaatccatggaggaaagcacttgtgtcatggggaccacccctacctgacccacccacggagtcagagtttggggaactcatggccgttgaggctcacccaggatggccatagccttcatggagacccatgccagtgtggccatgtctctagctcacctctagccctgcacacaggtggtcaggaccaatcttgggagtgttgcaagtgctatgtcgttaattgtagttttagtgcctcagtgacaaaccttgcagatcatttcccttcttctgagatgaatgcagatttgatggccctataatattactcttgcattcctcgatgcattcttaaatgggagcaaatgggatgggccccagatcactcactggaaacccacactccaggtgcctcatttcctctgcccaggagattgtagcctgggcacagctatatgaggagggcccatttggatactgctatcatggatgtcttagtggaaggaagtttagggataaccacaactctagaagtccaggttctggactcactttgcagactctagcagtacctgcctccattccctgcccactcaagctagtttctcagcaaagagaatatgaggaaatatccccaaacatcgtcatccccactgggatcctccacatgagtgtgggctggaaaggttccagggtcacactgaggcaggacattttttgccaatgcctgttaccccatggaaggctgaggtacggatgcacctgatctggaaatgcagcccaggtcagactccacatttctgcaacaaagcatcacctgcaatgactcttttcacgtcagtgggtcaaaggacagaaccagcttccgtgttttaggctcactagattgtctcatgctccccatggctattctgtttgggagaatttgatctaacccgaagcctaaaggaatcaatgtaatgttgaattgtattctatgtaa

SEQ ID NO: 165635 - DNA, 2001 bp, Homo sapiens
  Payload ID: 12604
  Gene Symbol: PLN
  Gene Name: phospholamban
  Uniprot ID: P26678
  ENST ID: ENST00000357525
  CDS Start-End: 193-351
aaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattt

SEQ ID NO: 165636 - DNA, 1786 bp, Homo sapiens
  Payload ID: 12605
  Gene Symbol: PLA1A
  Gene Name: phospholipase A1 member A
  Uniprot ID: Q53H76
  ENST ID: ENST00000273371
  CDS Start-End: 73-1443
gaggctgggttatatgatctctttggctttagggaattactccataccagctctgagatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaa

SEQ ID NO: 165637 - DNA, 728 bp, Homo sapiens
  Payload ID: 12605
  Gene Symbol: PLA1A
  Gene Name: phospholipase A1 member A
  ENST ID: ENST00000475963
  CDS Start-End: 1-675
aatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcaatgcattccagcttctcactgttgctcctaaccatggcatttccttgaagctaggatgctggtgattgtaacgatgttaaatgtgaagtaaaaatgtgtccagaatccatgaaataca

SEQ ID NO: 165638 - DNA, 1695 bp, Homo sapiens
  Payload ID: 12605
  Gene Symbol: PLA1A
  Gene Name: phospholipase A1 member A
  Uniprot ID: Q53H76
  ENST ID: ENST00000495992
  CDS Start-End: 30-1352
ataccagctctgagatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaa

SEQ ID NO: 165639 - DNA, 1775 bp, Homo sapiens
  Payload ID: 12605
  Gene Symbol: PLA1A
  Gene Name: phospholipase A1 member A
  ENST ID: ENST00000494440
  CDS Start-End: 110-1432
agtcacacctagtttttccttggactgtggagctttagattgttgagctccttgatcaacctggcccttgagcttccaggctggctcaggcgtcctctcctccaggtggatgcacaagtcttcctccatctggggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaa

SEQ ID NO: 165640 - DNA, 1456 bp, Homo sapiens
  Payload ID: 12605
  Gene Symbol: PLA1A
  Gene Name: phospholipase A1 member A
  Uniprot ID: Q53H76
  ENST ID: ENST00000488919
  CDS Start-End: 357-1208
gaattactccataccagctctgagatttccagctcagcgatgcccccaggtccctgggagagctgcttctgggtggggggcctcattttgtggctcagcgttggaagttcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcact

SEQ ID NO: 165641 - DNA, 706 bp, Homo sapiens
  Payload ID: 12606
  Gene Symbol: PINLYP
  Gene Name: phospholipase A2 inhibitor and LY6/PLAUR domain containing
  Uniprot ID: A6NC86
  ENST ID: ENST00000562365
  CDS Start-End: 253-603
ctccagcctgggcaactccgtctaaaaaaaataagaaaagaaagaaaaaaaagaaagagaccatcccaggaagttgtggggttggggaggcctagggttaggcaagaccttgaggcaggggttgaagccagggagtggtcagccagcactgtccctgcctgtccccatcccacagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaagcctga

SEQ ID NO: 165642 - DNA, 557 bp, Homo sapiens
  Payload ID: 12606
  Gene Symbol: PINLYP
  Gene Name: phospholipase A2 inhibitor and LY6/PLAUR domain containing
  Uniprot ID: A6NC86
  ENST ID: ENST00000569031
  CDS Start-End: 110-460
ggggtggaagggaccacatccagcaggctgagagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaa

SEQ ID NO: 165643 - DNA, 569 bp, Homo sapiens
  Payload ID: 12606
  Gene Symbol: PINLYP
  Gene Name: phospholipase A2 inhibitor and LY6/PLAUR domain containing
  Uniprot ID: A6NC86
  ENST ID: ENST00000562255
  CDS Start-End: 122-472
atttcacgaaggcatgggggtggccataggcggcctgaaatagaagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaa

SEQ ID NO: 165644 - DNA, 712 bp, Homo sapiens
  Payload ID: 12606
  Gene Symbol: PINLYP
  Gene Name: phospholipase A2 inhibitor and LY6/PLAUR domain containing
  Uniprot ID: A6NC86
  ENST ID: ENST00000599207
  CDS Start-End: 1-615
atgaggctctccaggagaccagagacctttctgctggcctttgtgttgctctgcaccctcctgggtcttgggtgcccactacactgcgaaatatgtacggcggcggggagcaggtgccatggccaaatgaagacctgcagcagtgacaaggacacatgtgtgctcctggtcgggaaggctacttcaaagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaa

SEQ ID NO: 165645 - DNA, 914 bp, Homo sapiens
  Payload ID: 12606
  Gene Symbol: PINLYP
  Gene Name: phospholipase A2 inhibitor and LY6/PLAUR domain containing
  Uniprot ID: A6NC86
  ENST ID: ENST00000612042
  CDS Start-End: 126-812
aggagaggggaagagagagaaggagagggaatcccagttcttgcagccactgggaatcaagaggcccaactccgtcttggtcttcaagcaaacaaacaaacaacaatgggccgtgggaagggtgaatgtgggtccagacccacccctcctcagcttcctataaaagctggggaccaggtactgctgatacacacaccatgaggctctccaggagaccagagacctttctgctggcctttgtgttgctctgcaccctcctgggtcttgggtgcccactacactgcgaaatatgtacggcggcggggagcaggtgccatggccaaatgaagacctgcagcagtgacaaggacacatgtgtgctcctggtcgggaaggctacttcaaagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaagcctg

SEQ ID NO: 165646 - DNA, 8526 bp, Homo sapiens
  Payload ID: 12607
  Gene Symbol: PLA2R1
  Gene Name: phospholipase A2 receptor 1, 180kDa
  Uniprot ID: Q13018
  ENST ID: ENST00000283243
  CDS Start-End: 208-4599
cccgagtgtcggttcactgtggagacagcggtggcggagtgggtctccagggctctgggctggcaaggcccccggagggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcaggataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtggatgggcctcaatcagctggatgaacacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggagagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataaggcaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatcaaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccagggtaagtaaagaagactaaacaggagtctcatctgtctttccctttacagcacagatgccattagaatgtgaattgggtcactattttaattattcttgaagtgattactggttttgaatcttaaccaaatcagatgggttttgatttattcatttccctaaactgtgatccattcttaaaaggggtaaattatgcattggttatttttcagaaagacaagaactattaaaagaaactccctattgaaaactctgaaatcaatgcgaataatagtttttgcattaatgtatctctactaaaatttgggggaattttaaaactaatctggtatctattcagacatttacctgcactcgtaccattaagaaagacagaaagaagcaaaaaaaaattaatcttgtatatgagaggaaaaggaaagggcttctgagaggattcttagttgtttcttttgaattcacttttaatagcaggatttggaaaatactaatttctgtgcttaagggtcacaggttctgggctctcaactgatatttaaggtgacattcatttttattaggtctaacatctcaagctaaaggagaaagaaaaataccttcttttaaatggcaaagaccttcattagcagcacacttttataaacaaccatatagttaaaatgtggccttaaactttcaattactaaatgatgattaagttggatattttaaaatgtcttatacataagcttaaagtaatatattgaaactttaacagttgtactgttaaaactcatggactttctgaaaaactaaatatataaaataatatgtaacactcttaataactggaagatataaaatgtaacttggatttaaaggagaagagctaaagatctgaattatagtctcattagaaccagacagatgttgttgagaagtactaaataaattagtaatctagatatctttattatgtaaatgagtttaggtgttctatttaataaactattttctgggaacgatctccttttatattagtctagttagtgtagatggtaaataatgattatgatactgtctgtaaataaaaaattacagattttattttcctttattagttccttataaagaaaacagcttcataatcaatatctaaaaatttactcattacataactgtttattgaattttatcaagaaaaaagtgtactgagcatggtggcacgcacctgtagtcccagctacttaggaggctgagggaagaggatcaactgagcccagaagttgaaggctgcagtgagctatggttgcaccactgcactcctgcctgggcaactgaatgagaccccacctcaaaaaagtgctgttctagaaacagaggtactaaggtgagcaacttggggtaagggctatcttttcatgccacttattttctaatgagggaaaattgacagtaactcagtaaagaaatgcatatgcataaaatagcaagtggttatgaaaatgaagtaaggttccatgatagagagaaactgggggactctcagggcctccctgagagtgtgcattttaattattacaaccaactgcctcaaaaccagtggccactaatcacaagggggagctctgagagaaagtatgaatgaatttctaagaggcaaaccatcatcattagaaatacaatttgaagagcataccactaagaatggaatccttgtggcctgcaacagttaatccagcttccaaaagcagctctttgctactgttataataatttacacactgggacagtctacctccataatttttttaagtattgggacttcattttttaaaagatattatattatgtggcagttgcatatttatgactcaaaaaataattggcttgaactcaccagatggtataaaagcccaatttaaccatcttttgagtggaattaaagttctgttcttttcaatggacttggtaaaaactgctaatcaaccagccttccagtcaaggtatatagtcacacataataatttgacaaaatacaccattaggaaagtgattttgcagaaagaagctgtattgcttctcagtgctccatactttgatgtttagtattgaacaacatctccagataatctggacccatggacagatcacacacttcttgccattactgaatttgcagaaatagtactgaagtattctgctacatttttatatttgcattttttttgaaactttttttcattttttttttttttttttggagatggagtcttgctctgttgccaggcaggagtacagtggcatgatctcagctcactgcaaccttcaactgcctggttcgagcaagtttcctgcctcagcctcccgagtagctgtgattacaggcacatgccaccatgcccagctaatttttgtatttttagtagagacagggtttcaccatgttgtccaggatggtctcgatctcctgatctcgtgatccacccgccccagcctcccaaagtgctaagattacaggcatgagccaccgcacctggcctcatctgtatttttaatgtgaactagattttatagctataattcgaaaagaaaaaaaagtagcaggtaatgggtatattatacactatttgcgtgatggttacaccagactttaccactacatactgtatttatgtaacaaaattacacttgtactccttacatttatgccaaaaaagcggcaggatcacaaattcacacatagttaatgtgcccctccaacagtcaattatgttctatgactaacctgaggatctttatagaatctgagtaatggaaatgcctgggtttttccatttaacaatatattgggctcttacagttacaacagtcttctttcgggttaaatatttcttctcttgaagggtccactccttattaaagataagattgaactgaatgtttacttaaacgttcagtcttttggagtttctttactcttctcaaaatggtggttggatatataagaacttgctgtgtcctggtagtgttgaggggagaaggtgacaacttactgtggatgtatgttagctggtgtccactgagaatagctgtctggcctcactcctgggaattctgctggcatctgctgtgaagtctgcagttgctttaatctgtagtctgttctctttgatttggcctcattctggctgtccctggtgctgtcttatctcttgagaactggctgtgtctcctgttgaattccctatccgaacactgcagttcttggctacaaggcagtcacttcacccctgcagtggtgagatcccattagctaccattagctactcttttcgtccagaaaggcgaaatgccatagcaaacaatcccacagtcttggtggattaacacagcaaaggtttatttctcacccacacctgcatgggctggcaagaggactttgctctgttcagtcattcatgggtccatgcttctcctatatagccagccctctgtctcctaaggcctggagtcctccatgggcctccaatctgtggctgacagaggatgttgacttgagacccatctttgattcattatggagcttccacaggctgttgaaatcctctaagtcaaaagtcctcaaactggggacacatgcctaaggaatacaggagcatgggtatttaagaaacttaatttccagaatcttcatgtatattttttcttaaaactgatttacctgagagcacccctggttcttctttcccacctctctttacacaaatgcctttctctacctttaaaaagaaaaagaaaaagaaatggctttcatttcagatcttactatgggaaaatcctccatggctccaaagaaaaatattcgaagtattgatgtcagtgaagcttcttttaataaagaaattgtaaactca

SEQ ID NO: 165647 - DNA, 5160 bp, Homo sapiens
  Payload ID: 12607
  Gene Symbol: PLA2R1
  Gene Name: phospholipase A2 receptor 1, 180kDa
  Uniprot ID: Q13018
  ENST ID: ENST00000392771
  CDS Start-End: 208-4182
cccgagtgtcggttcactgtggagacagcggtggcggagtgggtctccagggctctgggctggcaaggcccccggagggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcaggataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtggatgggcctcaatcagctggatgaacacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggagagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataaggcaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatcaaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataatcccagaacaccaaaaataaaaacaaacaataacatgtttatctttacccttagcaggaagatgcttggctggaactttgtgttcacagacttagtcattgcataccaaaaccatatttactggaaaatatcccaggtttctaaatgttataaaagcacaatagagttatggaaatgtttccatgatgaactgtgctgttaggattcttatttgctactcataaaaaccagagtttgtaataaaatggaagcatggtattcttttctttatgtaattgatggttattgaaaggtacttgtgaagaaaattattttaattggtatggagagcttgttacagtggtgtaccaaggttgggggtgagcctaccctttcgaggaggagtattttaatcaccaacattgtttagaatttcaagcagatggtgataataaaaagcagaccaacttttagttagctgtattgttagttttaaattattttcagacaatacactattgcccacacatgggatggactctcctaccgcccctacccccttggtacatggctggcttggtattaaagaaattcactgtaaaatctttttagaaagtgagccattttgtaatgatgaagatgttaggacttcaaaggatttttctttactcgattagttttgtttatcaaatgatttctttaaatcgattatatatatatatggaatatttcaaaattcaaactgtcacattaagaaacatgataacctaaatgacctaaataagaacactgtacctaaaataaagaggcaacttta

SEQ ID NO: 165648 - DNA, 565 bp, Homo sapiens
  Payload ID: 12608
  Gene Symbol: PLA2G1B
  Gene Name: phospholipase A2, group IB (pancreas)
  Uniprot ID: P04054
  ENST ID: ENST00000308366
  CDS Start-End: 37-483
tggtcatctcagttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagacctca

SEQ ID NO: 165649 - DNA, 423 bp, Homo sapiens
  Payload ID: 12608
  Gene Symbol: PLA2G1B
  Gene Name: phospholipase A2, group IB (pancreas)
  ENST ID: ENST00000423423
  CDS Start-End: 27-239
agttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagac

SEQ ID NO: 165650 - DNA, 562 bp, Homo sapiens
  Payload ID: 12608
  Gene Symbol: PLA2G1B
  Gene Name: phospholipase A2, group IB (pancreas)
  ENST ID: ENST00000549767
  CDS Start-End: 127-486
gagggagcaggaaggcagtgtgtccccggggtgctggcagaccgatttgaactctggctatgtcttcttgcagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaag

SEQ ID NO: 165651 - DNA, 970 bp, Homo sapiens
  Payload ID: 12609
  Gene Symbol: PLA2G2A
  Gene Name: phospholipase A2, group IIA (platelets, synovial fluid)
  Uniprot ID: P14555
  ENST ID: ENST00000375111
  CDS Start-End: 273-707
gaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaa

SEQ ID NO: 165652 - DNA, 974 bp, Homo sapiens
  Payload ID: 12609
  Gene Symbol: PLA2G2A
  Gene Name: phospholipase A2, group IIA (platelets, synovial fluid)
  Uniprot ID: P14555
  ENST ID: ENST00000400520
  CDS Start-End: 271-705
aggggtatgggcgaccaatcctgagtccaccaactgaccacgcccatccccagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatcatgt

SEQ ID NO: 165653 - DNA, 453 bp, Homo sapiens
  Payload ID: 12610
  Gene Symbol: PLA2G2C
  Gene Name: phospholipase A2, group IIC
  ENST ID: ENST00000247992
  CDS Start-End: 1-453
atgctcattgcaacttccttcttcctttttttctcatcggtggtggcagcccccacccacagcagtttctggcagtttcagaggagggtcaaacacatcacggggcgaagtgccttcttctcatattacggatatggctgctactgtgggcttggggataaagggatccccgtggatgacactgacagcccctcatctccctctccctacgagaagctgaaggagttcagctgccagcctgtgttgaacagctaccagttccacatcgtcaatggcgcagtggtttgtggatgcacccttggtcctggtgccagctgccactgcaggctgaaggcctgtgagtgtgacaagcaatccgtgcactgcttcaaagagagcctgcccacctatgagaaaaacttcaagcagttctccagccagcccaggtgtggcagacataagccctggtgctag

SEQ ID NO: 165654 - DNA, 3249 bp, Homo sapiens
  Payload ID: 12610
  Gene Symbol: PLA2G2C
  Gene Name: phospholipase A2, group IIC
  Uniprot ID: Q5R387
  ENST ID: ENST00000429261
  CDS Start-End: 62-511
acccctcacacacaggtgaaggcgtggctgtagaacctcagaccccctggtctcctcaggaatgaaggtcattgccatcctcaccctcctcctcttctgctcccccacccacagcagtttctggcagtttcagaggagggtcaaacacatcacggggcgaagtgccttcttctcatattacggatatggctgctactgtgggcttggggataaagggatccccgtggatgacactgacaggcacagcccctcatctccctctccctacgagaagctgaaggagttcagctgccagcctgtgttgaacagctaccagttccacatcgtcaatggcgcagtggtttgtggatgcacccttggtcctggtgccagctgccactgcaggctgaaggcctgtgagtgtgacaagcaatccgtgcactgcttcaaagagagcctgcccacctatgagaaaaacttcaagcagttctccagccagcccaggtgtggcagacataagccctggtgctagggacaccacagggtccctctcatcatccagcatccgctctagtgttgctcttccaggaagccttctcagatcatccccaacaggcccctgttcttccactgggagggaggacaaaatgtctcccgcagggcagctcacccttcagcattctgaccaaggggactccctgtcgttcagcatcagagggctggagagcagaaatgggaaagatgagatgcctgccctgcaggagctggcattctgtggagtggggaggactacaaatgcatggatatagaagtaagagacacattagactgtagtaagtgctatgatgcagtaaaacaaagggacgggatagagatgcacccaaccccacatcccagggtttccaggaggggagaagccccaggatctaccccaaactctctcttcacccccactgcaaaccgggacacagagcagacttgagcgccaggcccatgcccagctctagctggcaacaaagccaccactttccttgcccctctgcgtcctcagtttttatgatgtcattcttagcttttcttatcaagaggcagaatctgttttccccatcccatgaatctgaactggtcttgtggcttagtttggtcaatagaatgttgtgggagggatggtttaccagttttgagctaggcctcaggaggtctagggcatgtctactctctcttaggacagctgcccccaccctgcaaaaaagcctgggctagcctgctggaggatgagagcccacctggatcagttgtctcagctgatttcagacacgtgagagagagctcagcgagactcagcttgtagctgactacagatgtgtgagggaacctggctgagaccaaaacaactgtccagctgagcccaggctaaactgccaacatgcagaattgtgagctaaataaaggctgctgttctaagtcactgggttttggtatggtttgttaggcagccataactaacaggtgtaattggtccttattcccttattcactgagagtgatgggttctcagccctgagctggacttggaggccatggaaatgcagtggacatggcctttgttccttaccttgaaggtgtggaaggaggtcaagttcatggaataatggagaacacacagctgtaatcgtttgcttgttcagggaacacacatttattgagcacttgctatgtgccaggcacagtgccaggcagtagggatccagatatttaaagaaaacaaacaaaaatcaggtccaaaactcctggggagaatgctgagagtggtatcagcttttaggaattcagacacaaaatctggattgaaaaatggacagatgtgaagacagaaaaagacaccagatgtggagtgtcagtggagggtctgggggcccaggctcctgcgctctggctggctcagcttgtactatcatgtgggtgactggcctgctcttctgtcccacacacatgggtggaaattgcaactgcagatgggcagcttgaggtttacgaacatcagggagactgtaagccggccatgagggaagcagctgtagaaaggtgggcatggaaccaaggtggccaggcccaagccagcaggcacccccccaccttggggatcctgaccactgcagagaccagctccagactgtgaaggtgcctggctgaccgacacaatggaggaagaggggtgagggccaggcttagggtgggggatagggttcccgtgtgagatccaggccgtgtttttaaaaaaaatttttgagacagagtctcactctgtcatccaggatggagggccatggcacgatcgcagctcactgcaacctccacctcctgggtgcaagtgattctcctgcctcagcctcccaagtatctgggattacaagcgcccaccaccatgcccagctaatttttgtatttctagtagagacagggtttcatcatgctggccaggctggtctggaactcctgacctcaactgatccacccacctcagcctcccaaagtgctgggattacaggcatgagccactgcacccagccccaggccatctttttcactccctcctctcttccatcccctaaatctataagacagaaatgatgggcccttgatggtatgcaagccccatttgtttggcattgatgccctgattcttggagagctgagatgggagtgtagaagaatgggcagactctctctgggaaagcctactgtcctcgaagggaaatcatccattccatgagcacatgttactgaagacctactccaagccaggccctctgcaccagactccacggagctcttggaccaaagggaaaacaagtaagcaggggattgcagaacaagctgggggtgccaggattggggtgggcatggggagcaatgcccacctcctggaggatgagggaagctttcctgaggactgctgggggtctgacatctcatctgagacttgaagatgaggaggagttaggagggccggtggggccatgcagagcctcccaggttgaggtctggagaaaagcagcatatgtctatgcaagctccttgtccacctgccttgcccatctctgctgaaggctctttatcatttgtccctgcagcccaaaaacctgggtgttgaattatcatattccacatcccacacccaatctgttggcactaccttcacaatgcatctagattctgtatttataaaatgcttccatcaaatgtttacatggaaaaaaaaaaagagag

SEQ ID NO: 165655 - DNA, 2672 bp, Homo sapiens
  Payload ID: 12611
  Gene Symbol: PLA2G2D
  Gene Name: phospholipase A2, group IID
  Uniprot ID: Q9UNK4
  ENST ID: ENST00000375105
  CDS Start-End: 60-497
gggcagcctgcatggaaagggactgccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcatccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcaggattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaatccttgtctcaggctctgcttctaaggaaagagactgaagagggacaactttttcctatgaggactcccaatctgccatttgtgtgtggctagctgtttccagccagggggctgaggcacctgcagtcacccacactctgggcctgtggcaccatctgtgcctcagctgactgagcagttctgagatgtggtgactcatgtgaagtggtgtcataggaatgaaggactgtgggcgctgggttcaaattccagttctatgcaccactccaggtagggatacccatgggggcagctgtgcctgtgtgggggaacagggtagggaaatctccataccttctcaattttgctgtgaacctaaaactgccatataaagataaagtctaggccaggcatggtggctcatgcctgtaatcccaacacttagggtggctgaggcaggcagatcacctggggtcaggagttcaagaccagcctgcccaacatggcaaaacctcgtctctactaaaaatacaaaaattagccaggcatcgtggtgggtgcctgtaatcccagctattcaggaggctgaggcaggagaatcacttggacctgggaggcagaggtttcagtgagcccagatcgcgacactgcactccagcctgggcaacagagtgacactctgtctcaaaaaataaaataaaataaaataaaataaaataaaataaaataaaa

SEQ ID NO: 165656 - DNA, 1856 bp, Homo sapiens
  Payload ID: 12611
  Gene Symbol: PLA2G2D
  Gene Name: phospholipase A2, group IID
  ENST ID: ENST00000617227
  CDS Start-End: 69-257
gatataagggggcagcctgcatggaaagggactgccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactgctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcatccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcaggattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgc

SEQ ID NO: 165657 - DNA, 785 bp, Homo sapiens
  Payload ID: 12612
  Gene Symbol: PLA2G2E
  Gene Name: phospholipase A2, group IIE
  Uniprot ID: Q9NZK7
  ENST ID: ENST00000375116
  CDS Start-End: 59-487
ctgctttcttctgctgccttttatgctccttgtgcacctcccttccccccaacctgggatgaaatctccccacgtgctggtgttcctttgcctcctggtggctctggtcaccgggaacctggttcagtttggggtgatgatcgagaagatgacaggcaagtccgccctgcagtacaacgactatggctgttactgcggcatcggtggctcccactggccggtggaccagactgactggtgctgccacgcccacgactgctgctacgggcgtctggagaagctgggctgtgagcccaaactggaaaagtatcttttctctgtcagcgaacgtggcattttctgcgccggcaggaccacctgccagcggctgacctgcgagtgtgacaagagggctgccctctgctttcgccgcaacctgggcacctacaaccgcaaatatgcccattatcccaacaagctgtgcaccgggcccaccccgccctgctgaggctatgctcggcctcccccccgtccctggaggtcccgcctcgggctgctgtagtcccaggcctggggaacattggcaccaaaggccctccctttggaaaattcctttcctgcaaactcatccctccttgagagctcagagatatgtcctggaccatcactagcctcccaggctaccccttctctgtagaaagaaccctgccccaggagccatggacccttcagcacccagaagactgtcactagcttctgggatctcagctccctcttctgaataagtgaataatgttttcccataa

SEQ ID NO: 165658 - DNA, 2723 bp, Homo sapiens
  Payload ID: 12613
  Gene Symbol: PLA2G2F
  Gene Name: phospholipase A2, group IIF
  Uniprot ID: Q9BZM2
  ENST ID: ENST00000375102
  CDS Start-End: 103-738
agtgtgcgaggcagcgtgaagctggggcctgctccccgcagcctctggagcgcatctcagaccttctgagacctatgttgctggccccccagaacccgcaacatggcagatggggcaaaggccaaccccaaagggttcaaaaagaaggtgctggatagatgcttctctgggtggaggggcccacgcttcggggcctcctgtccttcaagaacctccaggtctagcctgggtatgaagaagttcttcaccgtggccatccttgctggcagcgttctgtccacagctcacggcagcctgctcaacctgaaggccatggtggaggccgtcacagggaggagcgccatcctgtccttcgtgggctacggttgctactgtgggctggggggccgtggccagcccaaggatgaggtggactggtgctgccacgcccacgactgctgctaccaggaactctttgaccaaggctgtcacccctatgtggaccactatgatcacaccatcgagaacaacactgagatagtctgcagtgacctcaacaagacagagtgtgacaagcagacatgcatgtgtgacaagaacatggttctgtgcctcatgaaccagacgtaccgagaggagtaccgtggcttcctcaatgtctactgccagggccccacgcccaactgcagcatctatgaaccgccccctgaggaggtcacctgcagtcaccaatccccagcgccccccgcccctccctagagcctctgaggtttgagagagagagcgggaggagggtctggcttggggaccagacgaggtgcagggagggtaggagccaggccaggagcctgagggttgctggttgcctcctccctggagctctccagtgagggctcagctctcagaggactcaggaaggcctgggtcctgactcccccagcccagccccaggcatgggtgcctcctgctgctggttctggactgggtgggaggcacggagcttataggggtctctcctgagggtggccggggagacctgagagagaggaggaggggcctctgagtggggcctctgttgctggcgccagtttaactccccggagccttagaaagtctgagccttagaaagtctgggcctgagcatccaggcccagagctggatgcatcctcggcccaagatcacaggaaggcagattgctggtcacaaagcatgggttccgggagcccctcagctgatcccacaggatggcctggggtggtggctactttgggcttgaagctctctagagccccattcacagagcaggtgccccaccccagccctcactgaggtggccatgagtccaggttcagaccctaggggatgtgcagtgctgagtgtcccagccctgaagtctagcctcagagcaggctcctgggcactgacagagccacacacccaggtacaccccccaggctaatatggggacacacaaaaatatggccttcaacacctacaagtcttctctgtgtcccccatcgacccatgcacatcaccccaaccctgctctgccacaccacgtgggtctgaggagcactcctaccccccggctccgggtccctgacagacactgccctcctggcctgcacctggaatggcagccagaacactggagggggacccacaccctctctccctgggctgtggatgggtgttgcaagtcccatccctcctggcctgcacctggaacagcagccagaacaccggagggggacccacaccctctctccctgggctgtgggcaggcgtcacaagtcccattggtggggaagaggctgagggctgagacccacctcagtgaagagggaaacgtaagcagggagagcatcaaggcgggaggcagcctggaaacttctagaagagggtcaaggtaggaggctacatggaagcttctagaaggcagtaaggaacagggtggtgaaggagaggggagaagatgggagcatggagagacgaggtgagtgacagccaccagcagggacgggcctccaggcaacacagaggagctgggggccagggccttacggggctgggttcctgtgtggggcgtggagctggggctgaagtggaggggacggccctgcggcccccagcactgttgtttctccaggtgcaccttaccttcctccttacctgcccgagcctcaactcagggtcagcagcctccacggagccagccccacctgcccgaaaaccactgaagccaccctccgcccggactcaacagccgccagcaagctcgcctggcagtgcccctggagcaccattgtcgctggggagggagagccgggaagggtggagaaggaggcagaagggacatgtatgaaaaaaggacaggaaacctgaccagaggcggtttccagagccccagccttggagacaaggacactgccacccagcgccacagtcagtctgggaggggcccacgccccccaccccccatgccacactgccgcctcttgctggccatggttctccggcttgggggaacgcaggttcccagctgcgcccctcccccgcgcacacacaccctcccctgtccctcggaaagactaggccagggtctggggatgggattctgctgccaggggtcctgcctgcccccactcaccccagacgcttcggatgctgcagctcctggataatctccacaggactcggcttcctctcctcaaatgaataaaggcctcctacctcaactccc

SEQ ID NO: 165659 - DNA, 2697 bp, Homo sapiens
  Payload ID: 12614
  Gene Symbol: PLA2G3
  Gene Name: phospholipase A2, group III
  Uniprot ID: Q9NZ20
  ENST ID: ENST00000215885
  CDS Start-End: 254-1783
atgggggcgtgggccctggcaagtgcactcctcagccaatcagcgtcctgcccggctggtggattcggttacaagcccaagatcaccccatactccagcctctttcctcctcctcccgcagctccattcattggtcccgccgcaccgggcctgctgggctccgcttccgttccactgctcagctgccgcctggtggggccaccaagggcaggcatcccaggggctttgtctgactggactgggccagtgcagaatgggggttcaggcagggctgtttgggatgctgggcttcctgggggtggccctggggggctcccctgccctccgctggtacaggacctcctgccacttgaccaaggccgtccctggcaacccactggggtacctgagcttcctggccaaggatgctcagggactggccctgatccatgcccgctgggatgcgcataggaggctgcagtcatgtagctgggaggatgagccggagctcaccgcagcctacggtgctctctgtgctcatgagactgcctggggctccttcatccacacccccggacccgagctgcagagagcactggccactcttcagagtcagtgggaggcatgccgagcgcttgaggagagtccagcaggggccaggaagaagcgagcagcagggcagagtggagtccctggtggagggcaccagcgagagaagagaggatggaccatgcctggcacactgtggtgtggagttggagattctgctgggaactcctcggagctgggggtcttccagggacctgatctctgttgccgggaacatgaccgctgcccacagaacatctcacccttgcagtacaactatggcatccgaaactaccgattccacaccatctcccactgtgactgtgacaccaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtgtaggatgtacggcacagtgcccctcgctcgcctgcagcccaggaccttctacaatgcctcctggagctcccgggccacctccccaactcccagctcccggagcccagcccctcccaagcctcgacagaagcagcaccttcggaaggggccaccacatcagaaagggtccaagcgccccagcaaagccaacaccacagccctccaggaccctatggtctctcccaggcttgatgtggcccccacaggcctccagggcccacagggtggcctaaaacctcagggtgcccgctgggtctgccgcagcttccgccgccacctggaccagtgtgagcaccagattgggccccgggaaatcgagttccagctgctcaacagcgcccaagagcccctcttccactgcaactgcacgcgccgtctggcacgcttcctgaggctccacagcccacccgaggttaccaacatgctttgggagctgctgggcacaacctgcttcaagctggcccctccactggactgtgtggaaggcaaaaactgttccagagaccctagggccatcagggtgtcagcccggcacttgcggaggcttcagcagaggcgacaccagctccaggataaaggcacagatgagaggcagccatggccttcagagcccctgagaggccccatgtcattctacaaccagtgcctgcagctaacccaggcagccaggagacccgacaggcagcagaagtcctggagccagtgacctcagtttcagctttcctgggcaccagcctggaccttgcccatggctatgccaagccttgggaatctcagcctcccctccgtaggttagactgaagcatggcagaggctgttgtggacaatcaagaggatgaatggggggatctcaaggcccaaatgctggaccacatctcctgctgttctgggtaaccttgagctatgtatgacacaactcttctatgcctggatgtggtgttcaggaagctcattctgatgccctgggctttggccttgccagggaacttcacatacagatgagaatggggaaagggtaacttattgcagcagccccaggcagtaccaggaggaggtacatgtatgtccgtgttgcaaaaataatacatgcctcaaaaacctgcctaggggagccctagtgcctgggtgctgtggcctgaggtagcaggtgggaagttagggatgtcacagaaatgtctgtgtctgaatccaggattggggtgggtgttggagagggctttcagctcccctcctcccaggggggcctctttttttaacggctgccgtgcccttcctggcccagccctaaacctaaattcaaatctcctccatgcctttgcgcaaaggacctccctcttgcactctaagccttagtttcctcctctaaaaaaagggggtctctaaacaggagctacctcatagggttgttgaggattaagtgaaccaatacatatacagtgcttagcacttaataagtattcccccctgcgacacctagctgaactatggtttggtgtctgatcttgagaggttgatgtaaccttttaaaggcctcagttcgctcacctgtgaaatgggtctaagaatagcactgatctcacagggttgtgatgcagattaaaggagatggcatgtgtaatg

SEQ ID NO: 165660 - DNA, 2875 bp, Homo sapiens
  Payload ID: 12615
  Gene Symbol: PLA2G4A
  Gene Name: phospholipase A2, group IVA (cytosolic, calcium-dependent)
  Uniprot ID: P47712
  ENST ID: ENST00000367466
  CDS Start-End: 153-2402
aggataagactttctctaagtccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacagggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggttgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataa

SEQ ID NO: 165661 - DNA, 2985 bp, Homo sapiens
  Payload ID: 12616
  Gene Symbol: PLA2G4B
  Gene Name: phospholipase A2, group IVB (cytosolic)
  Uniprot ID: P0C869
  ENST ID: ENST00000452633
  CDS Start-End: 353-2698
agacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtg

SEQ ID NO: 165662 - DNA, 264 bp, Homo sapiens
  Payload ID: 12616
  Gene Symbol: PLA2G4B
  Gene Name: phospholipase A2, group IVB (cytosolic)
  ENST ID: ENST00000569354
  CDS Start-End: 1-92
tgtcattggactacaacctccacggagccttccagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaag

SEQ ID NO: 165663 - DNA, 2496 bp, Homo sapiens
  Payload ID: 12617
  Gene Symbol: PLA2G4C
  Gene Name: phospholipase A2, group IVC (cytosolic, calcium-independent)
  Uniprot ID: Q9UP65
  ENST ID: ENST00000354276
  CDS Start-End: 329-1912
aagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagctctactacccgaaggatagtgcccgaagttgctgcttggcatagatgagcctcagcttccagggcactgtgggcctgttggtctactagggccctgatgtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggatt

SEQ ID NO: 165664 - DNA, 298 bp, Homo sapiens
  Payload ID: 12617
  Gene Symbol: PLA2G4C
  Gene Name: phospholipase A2, group IVC (cytosolic, calcium-independent)
  ENST ID: ENST00000598488
  CDS Start-End: 49-180
ggagcccaagcctccgcaccggattccggagcacaagctccaccgcgcatgcgcacacgccccagacccaggctcagagtttcactcttgttgcccagactggagtgcaatggcatgatctctgctcactggcacctccacctcctgagttcaagtgattctcctccctcagcctcctgagtagctgggattacaggcgcccgccatcatgcccaggaggactgagaattttctgaccgcagtgcaccatgggaagctctgaagtttccataattcctgggctccagaaagaagaaaa

SEQ ID NO: 165665 - DNA, 1984 bp, Homo sapiens
  Payload ID: 12617
  Gene Symbol: PLA2G4C
  Gene Name: phospholipase A2, group IVC (cytosolic, calcium-independent)
  Uniprot ID: Q9UP65
  ENST ID: ENST00000599921
  CDS Start-End: 359-1984
aaaaagctggagcaaccaagcagggcctacaagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatag

SEQ ID NO: 165666 - DNA, 438 bp, Homo sapiens
  Payload ID: 12617
  Gene Symbol: PLA2G4C
  Gene Name: phospholipase A2, group IVC (cytosolic, calcium-independent)
  ENST ID: ENST00000595161
  CDS Start-End: 1-391
gatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagcacccgcggtcggccacatccaacgaacttctgtgcatgtcggtttcctcagctgtaaaattgggctaacgatggctccaccaggagttgttctgtggattaaattaatacttgtt

SEQ ID NO: 165667 - DNA, 641 bp, Homo sapiens
  Payload ID: 12617
  Gene Symbol: PLA2G4C
  Gene Name: phospholipase A2, group IVC (cytosolic, calcium-independent)
  ENST ID: ENST00000599300
  CDS Start-End: 1-641
ggaagtgctcttggtaacactgaagtcattagggaatacatttttggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggacc

SEQ ID NO: 165668 - DNA, 516 bp, Homo sapiens
  Payload ID: 12617
  Gene Symbol: PLA2G4C
  Gene Name: phospholipase A2, group IVC (cytosolic, calcium-independent)
  ENST ID: ENST00000596138
  CDS Start-End: 398-516
tttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcagtggacaaggagaacccatgagcccgtgacagtcccagccctcccccactgtctttgctaagcccaacagtgggcacaggactaagaagagccatttctttggcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatga

SEQ ID NO: 165669 - DNA, 599 bp, Homo sapiens
  Payload ID: 12617
  Gene Symbol: PLA2G4C
  Gene Name: phospholipase A2, group IVC (cytosolic, calcium-independent)
  ENST ID: ENST00000595487
  CDS Start-End: 47-157
agcccaagcctccgcaccggattccggagcacaagctccaccgcgcatgcgcacacgccccagacccaggctcagactggagtgcaatggcatgatctctgctcactggcacctccacctcctgagttcaagtgattctcctccctcagcctcctgagtagctgggattacaggcgcccgccatcatgcccaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatcca

SEQ ID NO: 165670 - DNA, 293 bp, Homo sapiens
  Payload ID: 12617
  Gene Symbol: PLA2G4C
  Gene Name: phospholipase A2, group IVC (cytosolic, calcium-independent)
  ENST ID: ENST00000596352
  CDS Start-End: 153-293
ggagcccaagcctccgcaccggattccggagcacaagctccaccgcgcatgcgcacacgccccagacccaggctcaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacag

SEQ ID NO: 165671 - DNA, 2458 bp, Homo sapiens
  Payload ID: 12617
  Gene Symbol: PLA2G4C
  Gene Name: phospholipase A2, group IVC (cytosolic, calcium-independent)
  Uniprot ID: Q9UP65
  ENST ID: ENST00000599111
  CDS Start-End: 303-1958
agctgaaaaagctggagcaaccaagcagggcctacaagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgatgtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggatta

SEQ ID NO: 165672 - DNA, 581 bp, Homo sapiens
  Payload ID: 12617
  Gene Symbol: PLA2G4C
  Gene Name: phospholipase A2, group IVC (cytosolic, calcium-independent)
  ENST ID: ENST00000601946
  CDS Start-End: 1-581
ctaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagagaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccg

SEQ ID NO: 165673 - DNA, 669 bp, Homo sapiens
  Payload ID: 12617
  Gene Symbol: PLA2G4C
  Gene Name: phospholipase A2, group IVC (cytosolic, calcium-independent)
  ENST ID: ENST00000597713
  CDS Start-End: 1-104
atatgaagaagcccgtggaagaagggacactaccctacccaatatttgcagccattgacaatgacctgcaaccttcctggcaggaggcaagagcaccaggttagagtgcaatggcacgatctcggctcaccacaacctccgcctcccaggttcaagcgattctcctgccccagcctcccgagtagctgggattacaggcatgcgccatcacgcccagcgaattttgtatttttagtagagacgtggtttctccctgttggtcaggctggtctcgaactcctgacctcaggtgatccacccgcctcggcctcccaaagtgctgggattacaggcatgagccaccgcacccggccatctctcactttttagatgtcttccttctccataggtccgattatcacccaaatgctggcagctctccagacattccagtttctcttttgagctcatctctctcctgagatccagacctccttaccctatttcctaagcataaaatgcactcacttgttcagcaactgtgtcctgagacctggttcgagttcacccctcaccacgctggcttctctgcactgggggcctttgtttccataacccacttcggaagcaaattcaagaagggaagactggtcagaactcaccctgagagagacctgactttcctgagag

SEQ ID NO: 165674 - DNA, 3584 bp, Homo sapiens
  Payload ID: 12618
  Gene Symbol: PLA2G4D
  Gene Name: phospholipase A2, group IVD (cytosolic)
  Uniprot ID: Q86XP0
  ENST ID: ENST00000290472
  CDS Start-End: 96-2552
gctggtcctatcccactgggaccgtcgctgccactcagccagagagccagcatcttggcaagggctgggcctggagtgaagctggaagggctagcatggagagcctgtcacctgggggaccacctggccacccttaccagggggaggcctctacctgctggcagctcacagtgagggtcctggaggcgcggaacctgcgctgggctgacctgttgagtgaggccgacccttacgtgatcctacagctgtcgaccgcacctggaatgaagtttaagaccaagacgctcaccgacaccagtcatcctgtgtggaatgaggccttccgtttccttatccaaagtcaggtcaagaatgttctggagcttagcatctatgatgaggactcagtcacggaggatgacatctgcttcaaggttctctatgacatctcagaagtcctccctggcaagctgctccggaaaaccttctcccagagtccccagggagaggaggagctggatgtggagttcctgatggaagaaacgtcagatcgcccagaaaacctcatcaccaacaaagtcattgtggcccgagagctgtcatgcctggatgtgcatctggacagcacagggagcaccgctgtggttgcagatcaggacaagctggagctggagctggtgctgaaggggtcctatgaggacacacagacatccttcctgggcacagcctctgccttccgcttccactacatggcagccctagagacagagctgagcgggcgcctgaggagctccagaagcaatggctggaatggggacaactcagctgggtacctcactgtgcccctgaggcccttgaccattgggaaggaggtgactatggatgttcctgctccaaatgccccaggagtgaggctgcagctcaaggcagagggctgccctgaggagctggccgtgcacctgggcttcaatctctgtgcagaggagcaggccttcctgagcaggaggaagcaggtggtggccaaggccctgaagcaggccctgcagctggacagagacctgcaggaggatgaggtacccgttgtgggcatcatggccacaggaggaggtgcccgggccatgacctcactctacggccacctattggccttgcagaagctgggcctcctagactgtgtgacctacttcagtggcatctctggctctacgtggacaatggcccacctgtacggggaccctgagtggtcgcagagggacctggagggacctatcagatacgcccgggagcacctggccaagagcaagctggaggtcttttccccagagcgcctggcgagctaccgccgggagctggagctgcgggctgagcagggccaccccacgacctttgtggacctgtgggcgctagtgctggagtccatgctgcacggccaggtgatggatcagaagctgtcaggacagagagccgccctggaacggggtcagaaccctctgcccctctacttgagcctcaatgtcaaagagaacaatctggagacactggacttcaaggagtgggttgagttctccccctatgaggtcggtttcctgaagtacggggccttcgtccctcctgagctcttcggctccgagttcttcatgggacggctgatgaggaggatcccggagccccggatctgctttctggaagccatctggagcaacattttctccctgaacctgctggatgcctggtatgacctcaccagttctggggagtcctggaaacagcacatcaaggacaagaccaggagcttagagaaggagcccctgaccacctcggggacctcctcgcggctggaggcctcgtggctgcagccaggcacggcgctggcccaggcatttaaaggcttcctgacaggcaggcccctccaccagcgcagccccaacttcctccagggcctccagctgcaccaggactactgtagccacaaagacttctccacctgggcagactaccagcttgactccatgcccagccagctgacccccaaggagccccggctctgcctggtggacgccgcctacttcatcaacaccagctctccctccatgttccggccaggccgcaggctggacctcatcctctccttcgactactccctatctgcgcccttcgaggcactgcagcagacggagctgtactgccgggcccgggggctgcccttcccccgggtggaacccagccctcaggaccagcaccagccaagggaatgccacctcttctcagaccccgcctgccccgaggccccgatcctgctgcacttcccgctggtcaatgcctccttcaaggaccactcagcccccggtgtccagcgcagccccgcagagctccagggtggccaagtggatctcaccggggccacctgcccctacaccctgtccaacatgacctacaaggaggaagacttcgagcgcctgctgcggctcagtgactacaacgtgcagaccagccagggtgccatcctgcaggccctgaggaccgcgctgaagcaccggactctagaggcgaggcctccaagggcacagacctgaggttgctcagaggctgcaggaccctccagggcctgcgggcataacctgatctgtagctgggctcagccacaggccttcctggttggagttctgggctctcccaggcctgggtggcctctgtagctggtctcactgcccagagggaactgcacacacagacttctctcttacgttcatggctggcttgagatgagttgaaaataacttcgccaggccagtgtgtagaacagctggtccaaccagacagactttcacaccacaattacttccatgcctgagcaggatagatttgaagtgcaagccggaggcagcagatcaggagtagggacaggaaggacaggggatgcctgacctgacaggtggcttcaggcctcgggaatcacaagacatcctgaacacattgcctcctcatcttcttcctgctcctccacctcctcctctccttgtccttctcctctttgtcctcctgctttccgtatccaagtcttgtacttgtttaaatttattcctaaatattttattctttttgataagtggagttactttcttaatttcatttagattattcattgctattttatagaaatacaatggatttttaaatgttgatcttgtattccgcaatcttgctgaagttgtttaccggctctaatacttttgcggatttcttagaattttctgtagacagatcatgccatctccaaatagagatggttttacttcttcctgtctgatctgaatgccttttatttatttttcccaattgccctgagcagtacaatgatgaacacacgtttcaagagcagacatcttgtcttgttcctgactctgacaagaaagcataagtctctcaccatttagtgtgattttagctgtgggtttttcttggacatccttatcaggttgagaaagttctcttttatttctagtttattgagtgttttatgatgaaacggtgttaggttttgtcaagtgatttttctgtgtctatgggcatgatcatgtggttttgtcgtgtattttattaatgta

SEQ ID NO: 165675 - DNA, 5266 bp, Homo sapiens
  Payload ID: 12619
  Gene Symbol: PLA2G4E
  Gene Name: phospholipase A2, group IVE
  Uniprot ID: Q3MJ16
  ENST ID: ENST00000399518
  CDS Start-End: 488-3094
gtgaggctccttcaggggcctggatggcctcagccatttcacccccagccctctctccctccctctcccactgacatattgagtttcgcactttaaaaatagctctgcagcactaagaagctttctctgagcgtggatcccagccctgaaacgcaggcctcccttgacggagaactgtcctatgtgagcataatgctagctccctgcttgtctttcaggcagcgcaagaaatttctctccacaaaataggtccagatggtttgaaatattcacagagatagacgtggggctcctttagttaagccctggcttccttcagctccttaataattcatcctggcttagcttcaggaggagtctggtggcactgcttccctttcacacaaaactcccttgaaattaccccaggaggctccaacaacaccttactttgaggaccagcctcagctccacacagcccgtcctgagtcccagagaggaggctgggatgagtctccaggcctcggaaggctgtcctggcctgggaactaatgtgtttgtcccacagagcccacaaacggatgaagaaggcagcaggtcaggaagaagtttcagtgagttcgaggatacacaggacctggacactcctggtctcccacctttctgtcctatggctccttggggctctgaggaggggctgtctccatgccacctgttgacagtgagggtcatccggatgaaaaatgtccggcaggctgatatgctgagccagacagactgttttgtgagcctctggctgcccaccgcctctcagaagaagctgaggacaaggaccatctccaactgcccaaatccagagtggaatgaaagcttcaacttccagatccagagccgagtgaagaacgtgctagagttgagtgtctgtgatgaagacacagtgacaccagatgaccatctcctgacagttctctatgacctcaccaagctctgtttccgaaagaaaacccacgtgaagtttccactcaacccgcagggcatggaagagctggaggtggagttcctgctggaggagagtccctctccacctgagaccctcgtcaccaatggcgtgctggtgtctcgacaagtctcctgcctggaggttcatgcacaatccaggaggcggaggaagagggagaaaatgaaggacctcctggtgatggtgaacgaatcctttgagaacacccagcgtgtccggccctgcttggaaccctgctgcccaacctctgcctgcttccaaaccgctgcctgcttccactaccccaagtacttccagtcccaggtgcacgtggaagtgcccaagagtcactggagctgtgggctttgctgccgctctcgcaagaagggccccatcagccagcccctcgactgcctttccgatggtcaggtgatgaccctgcctgtgggtgagagttatgaattacacatgaagtctacaccctgccctgagacactggacgtgcggctgggcttcagcctgtgcccagcagagctggagtttctgcagaagcggaaggtcgtggtggccaaggccctgaagcaggtgctgcagctggaggaagacctgcaggaggacgaggtgccgctgatagccatcatggccactgggggtggaacaagatccatgacctccatgtatggccacctgctggggctgcagaagctgaacctcctggactgtgccagctacatcaccggtctatcaggggccacctggaccatggctaccttgtaccgtgaccctgactggtcctccaaaaacttggagcctgctatctttgaggctcggagacatgtggtaaaggacaagctaccctccctgttcccagaccagctccgcaaattccaggaggagctccggcagcgcagccaggaaggctacagggtcacctttacagacttctggggcctgctgatagagacctgcctgggggacgagagaaatgaatgcaaactgtcagatcagcgtgctgctttgagctgcggccagaaccccctgcccatctacctcaccatcaatgtcaaggatgatgtaagcaaccaggacttcagagagtggttcgagttctccccctacgaggtgggcctgcagaagtatggggccttcatcccctccgagctcttcggctccgagttcttcatggggcggctggtgaagaggatcccggagtctcgaatctgctacatgctaggcctgtggagcagcatcttctccctgaacctgctggatgcctggaacctgtcacacacctcggaggagtttttccacaggtggacaagggagaaagtgcaggacatcgaagacgagccgatcctgcctgaaatccccaaatgtgatgctaacatcctggagaccacggtagtgatcccagggtcatggctgtccaattctttccgagaaatccttacccatcggtccttcgtgtctgagtttcacaacttcctgtctgggctgcagctgcacaccaactacctccagaatggccagttctctaggtggaaagacacagtgctagatggtttcccaaaccagctgaccgagtccgcgaaccacctgtgcctgctggacactgcgttctttgtcaactccagctacccgcccctcctcaggccagagcgaaaagccgacctcatcatccacctcaactactgtgctgggtcccagacaaagcccctgaaacaaacctgtgagtactgcactgtgcagaacatccccttccccaaatacgagctgccagatgagaatgaaaatctcaaggaatgctacctgatggagaacccccaggaacccgatgcccccatcgtgactttcttcccactcatcaatgacactttccgaaaatacaaggcaccaggtgtagagcgaagccctgaggagctggagcagggccaggtggacatttatggtcccaaaactccctatgccaccaaggagctgacatacacagaggccacctttgacaagctggtgaaactctcagagtataacatcctgaataataaggacactctcctccaggctctgcggctcgcagtggagaagaagaagcgcctgaagggccagtgtccctcctaggccccagggagcctcccctgttctgtgtcagcttctaccatcagaggtgcaggacccctcagggctgaccaggttactacgcagccagctctgctctccggcaatgggtgtgagcaggttggcctgggctttctaacgaaaagtaaaaaattttaaaaagttgagaaagtcagaaagagagagagaggagctctgttggggttttatacccactagagtttcttcaagtgcttccctatagagaaggtggtctcatagccacaggctcccacacatctgtggagaggaaaagcctggggaagaggctgggcccccagaaacctcgactcagaggcagagcccagggctggcagccctcctctctctgtcctctacctcgtgtggcgggcctagggaaatgcacagaaggacctgagaggcactcggcgtttcactggaaaaacacttcaaaatttaaggcaattctagtcttgtgatttttgggtttttttagacggagtctcactctgttgcccaggctggagtgcaatggcgcgatctcggctcactgcaacctctgcctcccaggttcaagcaattctcttgcctcagcctcccaagtggccgggattagaggcacccgccaccatgcccagctaattttttgtatttttagtacaggctggtctggaactcctgacctcaggtgatccacctgcctcggcctcccaaagtgctgggattacaggcatgagccaacgcacccggccctagtctcattatttttataggcaattatatttcatgatttttatttttatgaatcggagtattaataggaagcatgaagctagaagatctagatggagccctagaaataagccagtctctgccacaacaaagccaaataggtggccggtttcagtggctctctccagctacccagagctccagggctggtgatccatgtcatcatgaccagacagccatgcccaagcatccagctccaaacaaatgccaggcaaagcctaagtctatagcccaggttcaccaaatgaggatctgggatggagttcagcaaggtcaggcaggctgtgggtaaatgaggttgggggccaggcaggcgatgcatccagcgctgcccactccagctgtcggtgctcactgacgaccctgctccaagagcatctctcagcctcttactgcccatctctctggctgcctcatgggattacttatttctaaatgtgattcctcttatctgtgttgtcaacaccgtgaccagtgcattccaactcttggagagtcacccacagagactgaaactgggaagaattagtgaaaaaggactaggttagccgtcagaggaagaagcccgccctttaagattgcttcctaatgaatctctgggaaaaccctgggacacagagaaacccaaagtcagcaggtctcccttcaggctgggaacataaccaaggaaatgtataaccggagccactgacaggcccaggctgatagaaggtgaaagcagaaaggcaggaagacatgaggtctgcaggaaacccagcaaccctggaaggcggagtcccctttctgggccaccatgctccctaagcagtctttgggttgtgaggaaaccagtggtgacaggtaccaaaagtttagaaaaattggcctccgatgtacatccttgctactcaaagtgcagtggggagctggttggaaatgcggaatctcaggccttagcccagctgtactaaattagaagctgcatttttcaggagattcccatccccaggcgccccccgtgattcctgtgcatattgaagtttgagaggcctggatttacgccactccctcccatgagcttggaacgtatgaatcagtgctcccttgagccactgataaactgagctctggacctgcaaaactggtccccatccaggtaatgctaacctgggacaccagccctcccctccaccagagcaactggctgcctccactttgacatcttttctttctgactgcaacagactctccttccagtatcaaagagtgagccaagcaacagacaggacttgtttatcgtaaggcgaaggcagccatgccttggattcatcaaaagtttgtgaaacgaggtttataaaatcatcatattatttgtgcatggaataaaatggccatgtgggtgaa

SEQ ID NO: 165676 - DNA, 3319 bp, Homo sapiens
  Payload ID: 12620
  Gene Symbol: PLA2G4F
  Gene Name: phospholipase A2, group IVF
  ENST ID: ENST00000290497
  CDS Start-End: 63-245
gcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggtgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctagga

SEQ ID NO: 165677 - DNA, 5587 bp, Homo sapiens
  Payload ID: 12620
  Gene Symbol: PLA2G4F
  Gene Name: phospholipase A2, group IVF
  Uniprot ID: Q68DD2
  ENST ID: ENST00000397272
  CDS Start-End: 88-2637
agtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaatgggtgtgtctagtaggggcatcagttcatcgggggagaggtgtgcacctgtatgtggggcaggagggtgtgcaagttcctggaggtgggttactccaaggcatgggcagtgcagagggagcctcgcctgggctcttgcctctttcccagatgcatccaatgggtcttggcaagttttgtttctcactctccctcttctccatttcccctgacccgccagggactctccaaatacctagaacctctctagtgtgggcagccctcagattcgtgaagaggagatcccgttctggccaggccctctccatctggccacggcctctgcagcatatgcctccagtgctgagctgcctaggagcctgcagcagcacttgagaccttgttccttctgccccctgtcccaggggctccctcttggctgcaccccctgctccatgctctctcacacagacacgctgtcaggaacacctgtgctgggaagccttacctgtcctgagtctggaaagaagactagttctggtttccaggttggggaagggtgactggagcccagcctgtgtcttggcctggcctgggatctgcagccctccagctggcatgagttgcgagggctgggggagccagttatttgggctggcatggggtggggacacctcagttctcctctgcctcctcaccatggctgcctgtcacaggccacggcccctccccttggttcagcagtgagaggtttatctgggagtttatctggctcctgctgtggccattgtcatcaacactgctgtgcctgccgtcatcaataacttgttagtaaaaccttcatagggttcacagctcagaactgcacagcgttcacaacttagaatctgtggtgtttcttcagtgcccattagagcctcaggctgtctctggctcctagaaagtcattctaccatctgttttgttcactgctgtatcctcagtgcctagagcagcagttgatacatggtaggtgctcagtaaatatttgataaatgaatgggaacctacattctaagaaatggatcgtcacccaccaaccacaaaaaagcatgcaatgctttcatgattcctaacccatgtggactttttgaagagctgatataaaccacagaccctctcccaagaaaaaggcatacacacacacatgaaaagttgcttacaataaggtctctgcttcagctatgtgatcagcagccccagggttgcagaggccagcgtctgtccccgcaggccagcaaggcttgtgaaggaggcaaacgtgggcttgtgcagagtgggcggggaccttctcacacagaagtgtaggcaatgccacttgtgctcagataaggtttgggaggagactgggacaagatcaagggcagggggcagggggcaggaggctgggctagtgctgtggcccagatattggccagaagtacagggaggatctcagccagggatggggaggctccaacaagactgaatctgggagccacgcagagcaagaagccaggggaggggccgaaggtaacccagccagtttaatgtctgctcctcaggagagatctgagtctttacctcattcccaacccttatctgagatggctggaaataagcttcagggtcctgaaggtgacagagttggagggatttgtctagaagagcaagcatggtttcccttgaagctgggtagaaacacaggagcagggacatcattcatcaacttgtcagagctcctcatgaggcaagggaagaaaaagggggccacaagtgtaggagattggtcagagtggtgggagaagctatagggaaaggagcaggccttctgaaaggttggaaggctctgcatagctttggaggagaatagctaaagacagctgttctataaccctgaggcagagggcaaggagtaggtacgagggagtgtgggggaatttatcttaaacaggcttgtttacttctgttgaccaggaactgacctttgatcatctacgcccatgaccttccctgaaaggggaacaataaatgttaattacctccagtgtttgctccaggcttttggcattgtgcctgcactgaataaaagcaagcagctccagcttctcagggctgcactttggccacttgagctgggcagtcccctagctgctcttacactgca

SEQ ID NO: 165678 - DNA, 3329 bp, Homo sapiens
  Payload ID: 12620
  Gene Symbol: PLA2G4F
  Gene Name: phospholipase A2, group IVF
  ENST ID: ENST00000569985
  CDS Start-End: 70-960
tgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacgcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcc

SEQ ID NO: 165679 - DNA, 1402 bp, Homo sapiens
  Payload ID: 12620
  Gene Symbol: PLA2G4F
  Gene Name: phospholipase A2, group IVF
  ENST ID: ENST00000562320
  CDS Start-End: 1-261
gtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaa

SEQ ID NO: 165680 - DNA, 574 bp, Homo sapiens
  Payload ID: 12620
  Gene Symbol: PLA2G4F
  Gene Name: phospholipase A2, group IVF
  ENST ID: ENST00000565553
  CDS Start-End: 88-300
agtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgccctccccaaggaaaccttttcagcaatgagagcttgaggccccggcccctccctgtcctacctgcagtgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacct

SEQ ID NO: 165681 - DNA, 584 bp, Homo sapiens
  Payload ID: 12620
  Gene Symbol: PLA2G4F
  Gene Name: phospholipase A2, group IVF
  ENST ID: ENST00000561627
  CDS Start-End: 61-420
agtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaac

SEQ ID NO: 165682 - DNA, 1161 bp, Homo sapiens
  Payload ID: 12621
  Gene Symbol: PLA2G5
  Gene Name: phospholipase A2, group V
  Uniprot ID: P39877
  ENST ID: ENST00000375108
  CDS Start-End: 269-685
cagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaa

SEQ ID NO: 165683 - DNA, 3271 bp, Homo sapiens
  Payload ID: 12622
  Gene Symbol: PLA2G6
  Gene Name: phospholipase A2, group VI (cytosolic, calcium-independent)
  Uniprot ID: O60733
  ENST ID: ENST00000332509
  CDS Start-End: 185-2605
aagtgctgagtaagccgaggtgagtgacctcgcgggtgggcggggcctgggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 165684 - DNA, 3060 bp, Homo sapiens
  Payload ID: 12622
  Gene Symbol: PLA2G6
  Gene Name: phospholipase A2, group VI (cytosolic, calcium-independent)
  Uniprot ID: O60733
  ENST ID: ENST00000335539
  CDS Start-End: 137-2395
gggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttc

SEQ ID NO: 165685 - DNA, 3011 bp, Homo sapiens
  Payload ID: 12622
  Gene Symbol: PLA2G6
  Gene Name: phospholipase A2, group VI (cytosolic, calcium-independent)
  Uniprot ID: O60733
  ENST ID: ENST00000402064
  CDS Start-End: 92-2350
tttgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaa

SEQ ID NO: 165686 - DNA, 781 bp, Homo sapiens
  Payload ID: 12622
  Gene Symbol: PLA2G6
  Gene Name: phospholipase A2, group VI (cytosolic, calcium-independent)
  ENST ID: ENST00000452794
  CDS Start-End: 1-374
atgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctaggcagtcacccaagccaggccggatggtgggcctggggtgcggcgtcagatgggtaacgccctgggcctggagaggccaccgagcctagccatgcggcattagctctagctctcactccctaatccgtccttcttagctgcgcacacaccacacgccccctcccctgcaccctgtccccggcctctctcagccactcttctgcttcccttgttcactgtggagccgtgtgccctggggagggggagacaccgcttcgcagccctcggttctgctttgctgcttctagactctgcacagtggtggggggctgtcagagttggggtcacgcgggctgctgcaccaggcacctggggactgggctgcttgtcaggaggggcagctagtcagttgggtggacgtcaggcaggccttggacacaaaggaagacatggacagagtggatggtgggcctgatcccggaggc

SEQ ID NO: 165687 - DNA, 567 bp, Homo sapiens
  Payload ID: 12622
  Gene Symbol: PLA2G6
  Gene Name: phospholipase A2, group VI (cytosolic, calcium-independent)
  ENST ID: ENST00000447598
  CDS Start-End: 67-366
aagtagaagtgctgagtaagccgagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgacgcctgggctccagtccctgtgtcctgagccccatgaggctgttactggtgctgctcgtctgcccatcctctccagtaacagccacctgaacactgcaattcctgggtttccatcattccttccagcctgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggccc

SEQ ID NO: 165688 - DNA, 364 bp, Homo sapiens
  Payload ID: 12622
  Gene Symbol: PLA2G6
  Gene Name: phospholipase A2, group VI (cytosolic, calcium-independent)
  ENST ID: ENST00000455341
  CDS Start-End: 126-364
atgagttgcttgaggtcacaccgatgaggttgaagctggaatctgacaccagagcctgtgtgattgtcctgatgtgtaagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgc

SEQ ID NO: 165689 - DNA, 656 bp, Homo sapiens
  Payload ID: 12622
  Gene Symbol: PLA2G6
  Gene Name: phospholipase A2, group VI (cytosolic, calcium-independent)
  ENST ID: ENST00000430886
  CDS Start-End: 159-656
agtgacctcgcgggtgggcggggcctgggggtccgttccccaacttcctcggcgctccggactcccaagtctccgccggaccctcctttggatattcctcgtgtctccgattctgagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtg

SEQ ID NO: 165690 - DNA, 552 bp, Homo sapiens
  Payload ID: 12622
  Gene Symbol: PLA2G6
  Gene Name: phospholipase A2, group VI (cytosolic, calcium-independent)
  ENST ID: ENST00000436218
  CDS Start-End: 93-548
gtttgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctccttggaaggaacgcagtggctggcctgaacca

SEQ ID NO: 165691 - DNA, 501 bp, Homo sapiens
  Payload ID: 12622
  Gene Symbol: PLA2G6
  Gene Name: phospholipase A2, group VI (cytosolic, calcium-independent)
  ENST ID: ENST00000417303
  CDS Start-End: 114-413
tcagatgccactttgttcagcaggcttcccagatcatccccaggctgactcaggttcctgtgtacaagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgacgcctgggctccagtccctgtgtcctgagccccatgaggctgttactggtgctgctcgtctgcccatcctctccagtaacagccacctgaacactgcaattcctgggtttccatcattccttccagcctgactcttccagctggagttggaggctgacgccctagtgaatttccatca

SEQ ID NO: 165692 - DNA, 1147 bp, Homo sapiens
  Payload ID: 12622
  Gene Symbol: PLA2G6
  Gene Name: phospholipase A2, group VI (cytosolic, calcium-independent)
  ENST ID: ENST00000448094
  CDS Start-End: 2-682
catggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctaggcagtcacccaagccaggccggatggtgggcctggggtgcggcgtcagatggaactacaggatctcatgcacatctcacgggcccggaagccagcgttcatcctgggctccatgagggacgagaagcggacatgcagaacctgagcccctgagaggtgaagtgacttgctcaaggtcacacggaccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcagg

SEQ ID NO: 165693 - DNA, 688 bp, Homo sapiens
  Payload ID: 12622
  Gene Symbol: PLA2G6
  Gene Name: phospholipase A2, group VI (cytosolic, calcium-independent)
  ENST ID: ENST00000427114
  CDS Start-End: 1-688
gtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcaggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagca

SEQ ID NO: 165694 - DNA, 499 bp, Homo sapiens
  Payload ID: 12622
  Gene Symbol: PLA2G6
  Gene Name: phospholipase A2, group VI (cytosolic, calcium-independent)
  ENST ID: ENST00000427453
  CDS Start-End: 1-473
tgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgatggagtctcgcactgtcgcccaggctggagtgcagtggcgcgatctcggctcaccacaacctccgcctcccaggttcaagcgattctcctgcctcagcctcccaagtagctgggactgcagaaagacaacgtggagatgatcaaggccctcatcgtgttcggagca

SEQ ID NO: 165695 - DNA, 591 bp, Homo sapiens
  Payload ID: 12622
  Gene Symbol: PLA2G6
  Gene Name: phospholipase A2, group VI (cytosolic, calcium-independent)
  ENST ID: ENST00000452542
  CDS Start-End: 1-591
tcctggtggagctggtgcagtactgccacactcagatggatgtcaccgactacaagggagagaccgtcttccattatgctgtccagggtgacaattctcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatca

SEQ ID NO: 165696 - DNA, 741 bp, Homo sapiens
  Payload ID: 12622
  Gene Symbol: PLA2G6
  Gene Name: phospholipase A2, group VI (cytosolic, calcium-independent)
  ENST ID: ENST00000454670
  CDS Start-End: 1-505
ggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaagttggaccaatctgacactcctccagcactgccggagagagcctgttttgcggggatggtgcggggagaagcccacctatcccgaacagagggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatcc

SEQ ID NO: 165697 - DNA, 612 bp, Homo sapiens
  Payload ID: 12622
  Gene Symbol: PLA2G6
  Gene Name: phospholipase A2, group VI (cytosolic, calcium-independent)
  ENST ID: ENST00000435484
  CDS Start-End: 211-510
ttgtttgcggaagtaggaggaagtagaagtgctgagtaagccgaggtgagtgacctcgcgggtgggcggggcctgggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgacgcctgggctccagtccctgtgtcctgagccccatgaggctgttactggtgctgctcgtctgcccatcctctccagtaacagccacctgaacactgcaattcctgggtttccatcattccttccagcctgactcttccagctggagttggaggctgacgccctagtgaatttccatcagtattcttcccagc

SEQ ID NO: 165698 - DNA, 675 bp, Homo sapiens
  Payload ID: 12622
  Gene Symbol: PLA2G6
  Gene Name: phospholipase A2, group VI (cytosolic, calcium-independent)
  ENST ID: ENST00000498338
  CDS Start-End: 316-675
aaactgaacagaaacctgatacaggtcacatcagatataattacattcaaatcagcccaactagctgagtggcgggaatgctcttgagctcaaataaaccagaaagtccgagtttccgagtgcacttccctgcatgtgcacttaggtccccctgccaccttgtaccacacctgctcacctctgctcaccctggccctctcctgcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagag

SEQ ID NO: 165699 - DNA, 595 bp, Homo sapiens
  Payload ID: 12622
  Gene Symbol: PLA2G6
  Gene Name: phospholipase A2, group VI (cytosolic, calcium-independent)
  ENST ID: ENST00000594306
  CDS Start-End: 444-595
accaccacctctccctggcttcttcccttggaagccagcagagctgacctccagggtctgcaggttcatgacgtcttctggaggcataaggagagaggtgactcttgagggactgacaactgccttgtccagtcagcagccacaaccctccaacgtccccctccctggccccaccagtccactccagagacatcctgtagaaggcccacccgctggcatgggctcctttctggctgctgagccattctgctcgctctgtgaggacagggaaaaaatgtgttttcctagctcttggcagtcagcactgctggagcctcctccctgctggaaggggagcaaggctggaagaaccaagcaccacagagaagcaacggcctggggttccagccccagttcagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcc

SEQ ID NO: 165700 - DNA, 1882 bp, Homo sapiens
  Payload ID: 12623
  Gene Symbol: PLA2G7
  Gene Name: phospholipase A2, group VII (platelet-activating factor acetylhydrolase, plasma)
  Uniprot ID: Q13093
  ENST ID: ENST00000274793
  CDS Start-End: 198-1523
gccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaa

SEQ ID NO: 165701 - DNA, 1747 bp, Homo sapiens
  Payload ID: 12623
  Gene Symbol: PLA2G7
  Gene Name: phospholipase A2, group VII (platelet-activating factor acetylhydrolase, plasma)
  Uniprot ID: Q13093
  ENST ID: ENST00000537365
  CDS Start-End: 179-1504
ggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattc

SEQ ID NO: 165702 - DNA, 1000 bp, Homo sapiens
  Payload ID: 12624
  Gene Symbol: PLA2G10
  Gene Name: phospholipase A2, group X
  Uniprot ID: O15496
  ENST ID: ENST00000438167
  CDS Start-End: 441-938
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaacaa

SEQ ID NO: 165703 - DNA, 587 bp, Homo sapiens
  Payload ID: 12624
  Gene Symbol: PLA2G10
  Gene Name: phospholipase A2, group X
  ENST ID: ENST00000567462
  CDS Start-End: 48-440
gtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcgtcttgctctgtcacccaggctggagtgcagtggtgtgatctcggctcacttcaacctctgccttttgggctcaagcgatcctcgcacctcagcctcctgagtagctggaatcacaggaccggcagagaacaaatgccaagaactgttgtgcaagtgtgaccaggagattgctaactgcttagccc

SEQ ID NO: 165704 - DNA, 1000 bp, Homo sapiens; identical to SEQ ID NO: 165702
  Payload ID: 12624
  Gene Symbol: PLA2G10
  Gene Name: phospholipase A2, group X
  Uniprot ID: O15496
  ENST ID: ENST00000621727
  CDS Start-End: 441-938

SEQ ID NO: 165705 - DNA, 587 bp, Homo sapiens; identical to SEQ ID NO: 165703
  Payload ID: 12624
  Gene Symbol: PLA2G10
  Gene Name: phospholipase A2, group X
  ENST ID: ENST00000634009
  CDS Start-End: 48-440

SEQ ID NO: 165706 - DNA, 5226 bp, Homo sapiens
  Payload ID: 12625
  Gene Symbol: PLA2G12A
  Gene Name: phospholipase A2, group XIIA
  Uniprot ID: Q9BZM1
  ENST ID: ENST00000243501
  CDS Start-End: 269-838
cgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcactttgggaggctgaggcggttggatcacttgaggtcaggagtttgagaccagctggccaacatggtgaaacagcgtctctactaaaaatacaaaaatttgccgggcgtggtggcgcatgcttatagtctcagctactcaggaagctgaggtacgagaatcacttgaacccaggaggtggaggttgcagtgagctgagattgtgccactgcactgcagcctgggcaacagagcaagactctaaaaaaaaaatggtttatcaatatttactattgaaatatttgtccaggtaactttacacttacaatgaattcatggattttgttagcagcattggctttctcaaaaggacaaactcaatatcgttataaaatataattcgtgatcacaaattatacaaaaatcagtagaaacagttttttatgttcagattaaaaaaaaaaacttgggataattttagatttacagaaaagttgcaaagatacatggagagcttctgtgaccactcacccagttcccccagtgttaaccttttatttaaccatgaagcatttgtcagaagctaagtaaccagcaatggcaattactattaacggaactttgactttatttttcagattgtactagttttttaattaatgtcatttttcttttccaggatccaatctaggataccacactgaattagtcgtcatgcctaattagcctctggtctgtgatagttccacagtctttctttttcataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaaccccctggaagtgggaatatccatatgtagtatttggaatttttctatatggaaaatttgtttctccctcccaccctaatttgtttacatcagtatggactcatgtatattttgtattttgggtaacacagtatttattttgttgcttaagttgtccagcttggctattaggagttctgccaggttggctactatgtccctttgatgtgcccatccttttgatttttgagcacttcttactttctggcactacaagatgctccaggttcatcttggatattccctgccccaaccctagaatccctagaatcaacccctgctccaaagagccctggttccttttgttggagaatcatacttagaaaccaagatctgggcattagatgtgcttgttgctactgggatgtcactgtttgtagcagagttgagaaatatgtatgtatattaatccatgcatatgtacacatctataattatttatgtgtgtacaaagctaaacatgagtttgtactgccgtcttcaactcaaaatttgtcccaaaattttgtggcatatgtttagattttaaagttgatattttccctattgacagaataaactcattaaaagagcaaaaaaaaaaaaaaaaaaaaaaaggcaagaactaactgtcagcagctctttgcaagaaatgtaatattgatactttaaaataatactgccttcaaatgatgcctgtctctttaaaatcttttgacatagttcttccagggacagatatggctgtatttatttcatagatggagaaactgagcacagagctgtaatgaagacagaattgagatataagggcaaaagctaattaaacgcatcctcacaggtagcctttctttcagtgaacctgtagactagtccagtaatacttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgctgcactccagcataggcgtcagaataagactctgtcttggaaagaagaaaaaaaattgttagcctaaaaccaactctctctaaatttaaaagagtgattatttatcttagtatttatagaagtatgagattatcagaaggtgcgatgcacaatgctcattattttatcctagtacaagacacgtataacatctaacagtaaagaagatggaatctttctataaaaacaattctgttattaatagttgactgacttcagtaactttgaggagtagaatgaaacttattaggcaagatctttccacatacactacattgtattgttcaaaattcatagaaattacttgcaatatattgatttaagccttatgtagtgactgttgctatatttgaagtagcatttttagtttgctgtttttcctcactgcttaatcctacaaaaaccagccatctgcctaaaaaataaaagagcaaaaatgaatcagtgcaaccggtatacgaaaaataataattattaataaaactgtaaaggga

SEQ ID NO: 165707 - DNA, 755 bp, Homo sapiens
  Payload ID: 12625
  Gene Symbol: PLA2G12A
  Gene Name: phospholipase A2, group XIIA
  ENST ID: ENST00000507961
  CDS Start-End: 148-360
tgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacgcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagacc

SEQ ID NO: 165708 - DNA, 1189 bp, Homo sapiens
  Payload ID: 12625
  Gene Symbol: PLA2G12A
  Gene Name: phospholipase A2, group XIIA
  ENST ID: ENST00000502283
  CDS Start-End: 166-729
gtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaa

SEQ ID NO: 165709 - DNA, 1128 bp, Homo sapiens
  Payload ID: 12626
  Gene Symbol: PLA2G12B
  Gene Name: phospholipase A2, group XIIB
  Uniprot ID: Q9BX93
  ENST ID: ENST00000373032
  CDS Start-End: 94-681
cctgcctgacatctgggtagggggtttgtccctggaattctgggacactggctggggtttgaggagagaagccagtacctacctggctgcaggatgaagctggccagtggcttcttggttttgtggctcagccttgggggtggcctggctcagagcgacacgagccctgacacggaggagtcctattcagactggggccttcggcacctccggggaagctttgaatccgtcaatagctacttcgattcttttctggagctgctgggagggaagaatggagtctgtcagtacaggtgccgatatggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcagcctgtgattccctggttgacactgtgttcaacaccgtgtggaccttgggctgccgcccctttatgaatagtcagcgggcagcttgcatctgtgcagaggaggagaaggaagagttatgaggaagaagtgattccttcctggttttgagtgacaccacagctgtcagccttcaagatgtcaagtcttcgagtcagcgtgactcattcgttcttccaacagtttggacaccacaaagcaggagaaagggaacatttttctacagctggaaagtgagtcctatcctttgaggaaatttgaaaaaagacatggagtggtttgaaagctactcttcatttaagactgctctccccaaccaagacacatttgcctggaaattcagttcttagcttaaagactaaaatgcaagcaaaccctgcaattcctggacctgatagttatattcatgagtgaaattgtggggagtccagccatttgggaggcaatgactttctgctggcccatgtttcagttgccagtaagcttctcacatttaataaagtgtactttttagaacatttggaaagaga

SEQ ID NO: 165710 - DNA, 2727 bp, Homo sapiens
  Payload ID: 12627
  Gene Symbol: PLA2G15
  Gene Name: phospholipase A2, group XV
  Uniprot ID: Q8NCC3
  ENST ID: ENST00000219345
  CDS Start-End: 84-1322
aagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcacgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaggtg

SEQ ID NO: 165711 - DNA, 943 bp, Homo sapiens
  Payload ID: 12627
  Gene Symbol: PLA2G15
  Gene Name: phospholipase A2, group XV
  ENST ID: ENST00000444212
  CDS Start-End: 55-693
gagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtg

SEQ ID NO: 165712 - DNA, 1346 bp, Homo sapiens
  Payload ID: 12627
  Gene Symbol: PLA2G15
  Gene Name: phospholipase A2, group XV
  Uniprot ID: Q8NCC3
  ENST ID: ENST00000413021
  CDS Start-End: 124-1080
gattggccggggggatgcgggggatgcgggcggcggggttaagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaacggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctc

SEQ ID NO: 165713 - DNA, 577 bp, Homo sapiens
  Payload ID: 12627
  Gene Symbol: PLA2G15
  Gene Name: phospholipase A2, group XV
  ENST ID: ENST00000565744
  CDS Start-End: 87-577
gttaagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtggatgaaaacgggccctacttcctggccctccgcgagatgatcgaggagatgtaccagctgtatgggggccccgtggtgctggttgccca

SEQ ID NO: 165714 - DNA, 929 bp, Homo sapiens
  Payload ID: 12627
  Gene Symbol: PLA2G15
  Gene Name: phospholipase A2, group XV
  ENST ID: ENST00000568082
  CDS Start-End: 36-929
cctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaactcagtggttccggctccaggacccttcccacctgacccctgcctggctctggcctgcagatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacct

SEQ ID NO: 165715 - DNA, 781 bp, Homo sapiens
  Payload ID: 12627
  Gene Symbol: PLA2G15
  Gene Name: phospholipase A2, group XV
  ENST ID: ENST00000564827
  CDS Start-End: 55-781
gagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggagtgcagtggcgcaatctcggctcactacacctctgcctcccaggctcaagcacttctcctgcctcagactccggataactgggattacaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaacggcagccgcaggcctggaaggacaagtatatccgggccttcgtgtcactgggtgcgccctgggggggcgtggccaagaccctgcgcgtcctggcttcaggagacaacaaccggatcccagtcatcggg

SEQ ID NO: 165716 - DNA, 1203 bp, Homo sapiens
  Payload ID: 12627
  Gene Symbol: PLA2G15
  Gene Name: phospholipase A2, group XV
  ENST ID: ENST00000566188
  CDS Start-End: 55-765
gagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaacggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtg

SEQ ID NO: 165717 - DNA, 584 bp, Homo sapiens
  Payload ID: 12627
  Gene Symbol: PLA2G15
  Gene Name: phospholipase A2, group XV
  ENST ID: ENST00000566978
  CDS Start-End: 57-317
gcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtagagatgggctttcaccatattggccaagctggtcttgaactcctgaccgcaagtgatccactcacctcggcctcccaaagtgctgggattacaggcatgagcccctgcgccctgcctcgaagtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtggg

SEQ ID NO: 165718 - DNA, 2594 bp, Homo sapiens
  Payload ID: 12628
  Gene Symbol: PLA2G16
  Gene Name: phospholipase A2, group XVI
  Uniprot ID: P53816
  ENST ID: ENST00000323646
  CDS Start-End: 356-844
cttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgattggctcagttcgccagataactcaactttcccattggctacctttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccggctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaatgagaaaaaaattacataaaacagatgacatgtatagaaataaaaaaatagaatggaggaactaattccaaatatataagtaatcctaagtggactaaatttgcaaagtaaaaggcaaacattacactggattaaaaaacaaatccagggaatacagtttacag

SEQ ID NO: 165719 - DNA, 1099 bp, Homo sapiens
  Payload ID: 12628
  Gene Symbol: PLA2G16
  Gene Name: phospholipase A2, group XVI
  Uniprot ID: P53816
  ENST ID: ENST00000415826
  CDS Start-End: 140-628
gggtgacctcacgccggcccggccaccgcggccattagacccggtccaattgctggggctgcagcgctgcctccgagaccgcgagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttg

SEQ ID NO: 165720 - DNA, 243 bp, Homo sapiens
  Payload ID: 12628
  Gene Symbol: PLA2G16
  Gene Name: phospholipase A2, group XVI
  ENST ID: ENST00000540943
  CDS Start-End: 161-243
cttgggttaaaaagtattctgaaagcatcctcactgtcctccctggtcccgcacagtgccagagccgggggtcttggactgagtcagagttgcatgggtgcatctggagggaccttgattggagagaggtgaggtcgcaggagctggtgcagccagtgtcatgtccgccctgactgacaaggccatcgtgaagaaggaattgctgtatgatgtggccgggagtgacaagtaccaggtcaacaa

SEQ ID NO: 165721 - DNA, 4234 bp, Homo sapiens
  Payload ID: 12629
  Gene Symbol: PLAA
  Gene Name: phospholipase A2-activating protein
  Uniprot ID: Q9Y263
  ENST ID: ENST00000397292
  CDS Start-End: 419-2806
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaaggaaatgagcaaaatgtaaatagaggggatatgtactttgctgagtattaaattggaact

SEQ ID NO: 165722 - DNA, 730 bp, Homo sapiens
  Payload ID: 12629
  Gene Symbol: PLAA
  Gene Name: phospholipase A2-activating protein
  ENST ID: ENST00000523212
  CDS Start-End: 1-730
acggggcctggtgtgctgcgcctatccgccgggagcctttgtgtccgtgtcccgagaccgcaccacccgcctctgggccccagacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatc

SEQ ID NO: 165723 - DNA, 2041 bp, Homo sapiens
  Payload ID: 12629
  Gene Symbol: PLAA
  Gene Name: phospholipase A2-activating protein
  ENST ID: ENST00000520884
  CDS Start-End: 189-2018
gtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaaggtaaataaacactcttcaaaaatgtaaccag

SEQ ID NO: 165724 - DNA, 868 bp, Homo sapiens
  Payload ID: 12629
  Gene Symbol: PLAA
  Gene Name: phospholipase A2-activating protein
  ENST ID: ENST00000517642
  CDS Start-End: 1-868
tttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcagga

SEQ ID NO: 165725 - DNA, 625 bp, Homo sapiens
  Payload ID: 12629
  Gene Symbol: PLAA
  Gene Name: phospholipase A2-activating protein
  ENST ID: ENST00000487173
  CDS Start-End: 1-409
tattgataacacaaaaggtcaaatgttgggacttgggaatcccagcttttcagatccatttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaaggtaaataaacactcttcaaaaatgtaaccagaaagcaagaagttttatcttcatttctatcaatattactggtatttgtggattaaatgaaagttaacttcggtagttctaaatcactatggaaaatcttcacgaaaagggttcactacactactggaattgatgatcttgtttccgttacatgccttttgagaatctgaaggtaatatatgatccccatatat

SEQ ID NO: 165726 - DNA, 2426 bp, Homo sapiens
  Payload ID: 12630
  Gene Symbol: PLBD1
  Gene Name: phospholipase B domain containing 1
  Uniprot ID: Q6P4A8
  ENST ID: ENST00000240617
  CDS Start-End: 654-2315
agtgtgtctagtgtcagccccgtctgaatcactctcctgtggtggctccagccaacgaagaggaagcaaaaaggataaaaaatctgagctacagcgcatggatttaggttaaacagcctgggaatgaggggtacgctaatcgctgaggaaaacgcacctgtggaggcctctccagaaacagcagaggatccgagctgcgtgtaggcagggcgcgcatgtcaccctggcccgggcgcctggtccgctgctggagataaatggtcgaccccggagggagaggctagtaggggtgttgatgtgaactgattcgcccaagccttgggccgcaaaactgcgaaagaaagcggcaggcagcctctgcatttcccagaagtgcagctggggaactttcccagaccggcccaggggttgctagagggtcagacgtaaaggatccgcctttcctaggcggggtgggccccaggccaccacgtgaagcgtcctcgcccctcagagcccggagcaggccgggctcaagaaagaggaaagttgaggacgccccacctcggagaggcggcgcccctgagtaggccaggagcctctcttgcaacttctgccaccgcgggccaccgcggccgcctgatcccgcagaggaaggtcgcggccgtggagcgatgacccgcggcggtccgggcgggcgcccggggctgccacagccgccaccgcttctgctgctgctgctgctgctgccgctgttgttagtcaccgcggagccgccgaaacctgcaggagtctactatgcaactgcatactggatgcctgctgaaaagacagtacaagtcaaaaatgtaatggacaagaatggggacgcctatggcttttacaataactctgtgaaaaccacaggctggggcatcctggagatcagagctggctatggctctcaaaccctgagcaatgagatcatcatgtttgtggctggctttttggagggttacctcactgccccacacatgaatgaccactacacaaacctctacccacagctgatcacgaaaccttccatcatggataaagtgcaggattttatggagaagcaagataagtggacccggaaaaatatcaaagaatacaagactgattcattttggagacatacaggctatgtgatggcacaaatagatggcctctatgtaggagcaaagaagagggctatattagaagggacaaagccaatgaccctgttccagattcagttcctgaatagtgttggagatctattggatctgattccctcactctctcccacaaaaaacggcagcctaaaggtttttaagagatgggacatgggacattgctccgctcttatcaaggttcttcctggatttgagaacatcctttttgctcactcaagctggtacacgtatgcagccatgctcaggatatataaacactgggacttcaacgtcatagataaagataccagcagtagtcgcctctctttcagcagttacccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatgccagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttca

SEQ ID NO: 165727 - DNA, 553 bp, Homo sapiens
  Payload ID: 12630
  Gene Symbol: PLBD1
  Gene Name: phospholipase B domain containing 1
  ENST ID: ENST00000540572
  CDS Start-End: 120-553
ggaggtgaaccagaatggagagatgggcgtgatgagtgcagggattgtgtagggacggacccacaaaattatcaacaccatacggagtcacaggagtctactatgcaactgcatactggatgcctgctgaaaagacagtacaagtcaaaaatgtaatggacaagaatggggacgcctatggcttttacaataactctgtgaaaaccacaggctggggcatcctggagatcagagctggctatggctctcaaaccctgagcaatgagatcatcatgtttgtggctggctttttggagggttacctcactgccccacacatgaatgaccactacacaaacctctacccacagctgatcacgaaaccttccatcatggataaagtgcaggattttatggagaagcaagataagtggacccggaaaaatatcaaagaatacaagactgattcattttggagacatacaggctatgtgatggcacaaatagatggcctctatgtaggagcaaagaagagggctatattagaagggacaaagccaatgaccctgttcca

SEQ ID NO: 165728 - DNA, 857 bp, Homo sapiens
  Payload ID: 12630
  Gene Symbol: PLBD1
  Gene Name: phospholipase B domain containing 1
  ENST ID: ENST00000541618
  CDS Start-End: 33-155
atcccgcagaggaaggtcgcggccgtggagcgatgacccgcggcggtccgggcgggcgcccggggctgccacagccgccaccgcttctgctgctgctgctgctgctgccgctgttgttagtcaccgcggagccgccgaaacctgcagacacatgaatgaccactacacaaacctctacccacagctgatcacgaaaccttccatcatggataaagtgcaggattttatggagaagcaagataagtggacccggaaaaatatcaaagaatacaagactgattcattttggagacatacaggctatgtgatggcacaaatagatggcctctatgtaggagcaaagaagagggctatattagaagggacaaagccaatgaccctgttccagattcagttcctgaatagtgttggagatctattggatctgattccctcactctctcccacaaaaaacggcagcctaaaggtttttaagagatgggacatgggacattgctccgctcttatcaaggttcttcctggatttgagaacatcctttttgctcactcaagctggtacacgtatgcagccatgctcaggatatataaacactgggacttcaacgtcatagataaagataccagcagtagtcgcctctctttcagcagttacccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctg

SEQ ID NO: 165729 - DNA, 4800 bp, Homo sapiens
  Payload ID: 12631
  Gene Symbol: PLBD2
  Gene Name: phospholipase B domain containing 2
  Uniprot ID: Q8NHP8
  ENST ID: ENST00000280800
  CDS Start-End: 32-1801
cccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcacgtataacaaccagtggatgatcgtggactacaaggcgttcatcccgggtgggcccagccccgggagccgggtgcttaccatcctggagcagatccccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggccccatgctgtgcttcttggggtggcagggaaggtggggtcagcgctttttctcctctcaggtttgggttctgcgccatcccccatgcagcctcctgtgcagccctctgtctgtccttctgtccattcattcatctgccaacatactcacccatcatccatctgcacagccttccacccacccatccgtcttccatcatccatccatccatctacctatccatttatcatccatccactcacccatccaaccacccatccaaccattcagccatctccatctgtccattttctttcttcttcttttttttttgtttttgttttttctgagtgggagtttcactctattgcccaggctggagtgcaatggcataatctctgctcactgcaacctctgcttcctgggttcaagcgattctcctgccttagcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgactcatccatccacctatgagatcagacagggagggatccttttttgtattggtctgtataccacagcatggcttacgaagttcttatctatctatcacccatccacccacccatttatctacccacccattcatccacccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcacccatttacccatccatccatccatccttccaaccatttatccacccatccaaacatttccatctgtttttccatccatctacccatccacccattcactcatccatccaccttcctatccatttatcatccatctacccactcacccatccatccaaccttccaaccatttatccacccatccaactatttccatctgttcattttccacccatttacccatctactaattcactcatccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccacccactcatccatccattcatccatccacccacccacccgtccatccacctacctattcatttatcacccatccatccacacacgggtctgtgcagattcattaatatccacccatgcatccatatttatctattttctatccatcagccatccattcattcatatccatccatccatctatccatccagatgtttattgagcacctgtgttctgggtcctatttgggagccttgttaaccaccaagaccttcctaagccatattgtggtatacagacagatacaaaaaaaaaggctctctccctgtctgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaatgaaatatgcagtgtgtcagtgctggtaaacccgtggagaaaataaagcaaggttggggtctggggttgggaa

SEQ ID NO: 165730 - DNA, 2321 bp, Homo sapiens
  Payload ID: 12631
  Gene Symbol: PLBD2
  Gene Name: phospholipase B domain containing 2
  Uniprot ID: Q8NHP8
  ENST ID: ENST00000545182
  CDS Start-End: 36-1709
gtgacccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcaccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcc

SEQ ID NO: 165731 - DNA, 465 bp, Homo sapiens
  Payload ID: 12631
  Gene Symbol: PLBD2
  Gene Name: phospholipase B domain containing 2
  ENST ID: ENST00000548997
  CDS Start-End: 1-159
gatgggcaggtccctccagcctcccgcagccgctcggtgctcctggacgtctcggcgggccagctgcttatggtggacggacgccaccctgacgccgtggcctgggccaacctcaccaacgccatccgcgagactggctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaacctt

SEQ ID NO: 165732 - DNA, 5107 bp, Homo sapiens
  Payload ID: 12632
  Gene Symbol: PLB1
  Gene Name: phospholipase B1
  Uniprot ID: Q6P1J6
  ENST ID: ENST00000327757
  CDS Start-End: 45-4421
ggagcagctcttccagaggcccgagtcacctggagcattctggcatggggctgcggccaggcattttcctcctggagctgctgctgcttctggggcaagggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacagaatgggcttgcggcgggcggcgtggatgagctgatgggggtgctggactacctgcagcaggaggtccccagagcatttgtaaacctggtggacctctctgaggttgcagaggtctctcgtcagtatcacggcacttggctcagccctgcaccagagccctgtaattgctcagaggagaccacccggctggccaaggtggtgatgcagtggtcttatcaggaagcctggaacagcctcctggcctccagcaggtacagtgagcaggagtccttcaccgtggttttccagcctttcttctatgagaccaccccatctctacactcggaggacccccgactccaggattctaccacgctggcctggcatctctggaataggatgatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagtgcaggaggggacggctccctggagaatgtgaccaccttacctaatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcatagagtaaatttccatgaagactggaaggtcatcacagtgctgatcggaggcagcgatttatgtgactactgcacagattcgaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgtcgcagcctggcagagaggtcaaactccttcaataaccaagaagccacgtgatgatgtgtaactactagggcatcagtaggtaaatgtgtctgattgttttaaagaatagaaagggttcttcggggaaagtttcttgggggagagcaaccttcacat

SEQ ID NO: 165733 - DNA, 4431 bp, Homo sapiens
  Payload ID: 12632
  Gene Symbol: PLB1
  Gene Name: phospholipase B1
  ENST ID: ENST00000404858
  CDS Start-End: 1-4340
ggctgcggccaggcattttcctcctggagctgctgctgcttctggggcaagggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacaggcaccctcacttagcacggttctcctctcacagaatgggcttgcggcgggcggcgtggatgagctgatgggggtgctggactacctgcagcaggaggtccccagagcatttgtaaacctggtggacctctctgaggttgcagaggtctctcgtcagtatcacggcacttggctcagccctgcaccagagccctgtaattgctcagaggagaccacccggctggccaaggtggtgatgcagtggtcttatcaggaagcctggaacagcctcctggcctccagcaggtacagtgagcaggagtccttcaccgtggttttccagcctttcttctatgagaccaccccatctctacactcggaggacccccgactccaggattctaccacgctggcctggcatctctggaataggatgatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagtgcaggaggggacggctccctggagaatgtgaccaccttacctaatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcatagagtaaatttccatgaagactggaaggtcatcacagtgctgatcggaggcagcgatttatgtgactactgcacagattcgaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttc

SEQ ID NO: 165734 - DNA, 1661 bp, Homo sapiens
  Payload ID: 12632
  Gene Symbol: PLB1
  Gene Name: phospholipase B1
  ENST ID: ENST00000444257
  CDS Start-End: 1-834
ttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggtaggcccccgaccaaccccatggggacctgagaaggaaggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaa

SEQ ID NO: 165735 - DNA, 3543 bp, Homo sapiens
  Payload ID: 12632
  Gene Symbol: PLB1
  Gene Name: phospholipase B1
  ENST ID: ENST00000436544
  CDS Start-End: 1-1533
cagctctgtcctggctggctgggccccacctcaacctctgctgtgcagcttttccttctaggagagatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagagaaagtaaaccagggttcttatcagactcctgggtcagcaaatccaacaggaaatgcaccagaaaagcaccaaatccctgaatcttcacctccccgcttgcatgtatacgtgtacacgtggtgttcctacgtctctgtttactgtctttatgtgtttattcatgttgtcttgtagtcacacagctgcctttacatatatgtacacatctgcacagaaaacctctgaaacccatcgcacacttcgagaggccataaccaagacacaatcacaatcagccatgtcttgaaagattagcaattcgacaagaggaaagggtgagaaagggcatcccgaacacggaagtggagaagctcagggtgtgtcaggcgagcggttgcgtgtagatattctcaagtttctttctctcctaataaagttctcattcctgtaggcttcaaagtaagtggcgagtagctcagaatttacctgggaaaacaactagaacgaagctggccacaagggggcagcgtgctaatgagtggcggagccaggacagcacctttgctgccgcctcccttttcttctgagtcagtttgcttcctggggaagtgacagggagcagggagggggtgatcaagactgtgaaggttctctggccagacctgagcagagtcccagagaggatgggtttccagggcgagagggaggcgccatcactcggcctgtaccacccacaacgaggacctaggttgtccttagcatgaggacatcaacctctcaagaacagaggtcagtgccttcctgcgccaaggtccctgcgtttccacaagtccttggtcaggtacctggtcctaacaggctgccatggaacaaatcagagcctcactgactcaccattctgctcctaatgaggctacaagaaaaaaaaccagaggagagaaagcagagcttattacaatcaggaaagagcatgaggttctggcagctgcacttggtctcagctaaagaaggcaatgacctcatacgatagcatgggaaacaaaaatcaagcagacgaaccacattgcaggtgatagatacgcgacgtgcacctggtggggcagcctggggaagtgaggtgatgtgccctactttaaaacagatcgaccagctgggctcctgggattcagatatgaaccagcagtcctctactaaaagtttctttctgcagcgatgggaaaattcagccattgctctgtttcttccaacaagtgaagtccattacagcctaatgtctcaatcttttagttctagctctaaggcctcaggttcaatggctgctgtccctttaaacccttcatttgtcctaaatgtttcaaatagctgcccccaaatgcacgtgtgttaaagatggaagctctaggtcggggtctgagagacagcttgacacttggtagaatacatagactactgtgtctcaaagtgtgttccatggaacattaactccagacctgttcctggagaagagaaaatcctttgtatctgagggggaaacattaccataaccttcctttggggaattcatgtgtgtattagcatattaaaggctctcataaggcctgcaatgcagaaatctatttaagttttatctgtttaacccaatgtttcccttaattccagaacattttctttgttcataacacctgttaacacctcctgaaagtgttcacgtagtagacttatctgagaaaagcaatttttgagccgttaaagcttctagattggacaaactaggcaattaatgatactagatcaattcagaatgcaatttgagcctcttccccctgggaaacaaagtgaaaagagtggatctcatggaattaggggagaagtagacccagaattcatggggggtgggtggctgtgaacaggacctgcagaagaggctcggctgtgaatatttccaaggccccttgacctgtgagattctgtagtgaacggttccagctttggccagcttaacaatgtgctgggccccaaggtcttgagagcattgccttttcttccattgaaataagttcgcttgtttgggaccattcaaaggatcaaaataaaatttacttaccaaaaaa

SEQ ID NO: 165736 - DNA, 690 bp, Homo sapiens
  Payload ID: 12632
  Gene Symbol: PLB1
  Gene Name: phospholipase B1
  ENST ID: ENST00000436775
  CDS Start-End: 1-484
gaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatggagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctatttta

SEQ ID NO: 165737 - DNA, 1673 bp, Homo sapiens
  Payload ID: 12632
  Gene Symbol: PLB1
  Gene Name: phospholipase B1
  ENST ID: ENST00000411743
  CDS Start-End: 1-187
ctttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctatttta

SEQ ID NO: 165738 - DNA, 716 bp, Homo sapiens
  Payload ID: 12632
  Gene Symbol: PLB1
  Gene Name: phospholipase B1
  ENST ID: ENST00000416713
  CDS Start-End: 167-716
agtaccgttcgccttccgccatgattgtgaggcctctccagccacgcagaactggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacaggcaccctcacttagcacggttctcctctcacagaatgggcttgcggcgggcggcgtggatgagctgatgggggtgctggactacctgcagcaggaggtccccagagcatttgtaaacctggtggacctctctgaggttgcagaggtctctcgtcagtatcacg

SEQ ID NO: 165739 - DNA, 5115 bp, Homo sapiens
  Payload ID: 12632
  Gene Symbol: PLB1
  Gene Name: phospholipase B1
  Uniprot ID: Q6P1J6
  ENST ID: ENST00000422425
  CDS Start-End: 45-4388
ggagcagctcttccagaggcccgagtcacctggagcattctggcatggggctgcggccaggcattttcctcctggagctgctgctgcttctggggcaagggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacaggcaccctcacttagcacggttctcctctcacagaatgggcttgcggcgggcggcgtggatgagctgatgggggtgctggactacctgcagcaggaggtccccagagcatttgtaaacctggtggacctctctgaggttgcagaggtctctcgtcagtatcacggcacttggctcagccctgcaccagagccctgtaattgctcagaggagaccacccggctggccaaggtggtgatgcagtggtcttatcaggaagcctggaacagcctcctggcctccagcaggtacagtgagcaggagtccttcaccgtggttttccagcctttcttctatgagaccaccccatctctacactcggaggacccccgactccaggattctaccacgctggcctggcatctctggaataggatgatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagtgcaggaggggacggctccctggagaatgtgaccaccttacctaatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcatagagtaaatttccatgaagactggaaggtcatcacagtgctgatcggaggcagcgatttatgtgactactgcacagattcgaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgtcgcagcctggcagagaggtcaaactccttcaataaccaagaagccacgtgatgatgtgtaactactagggcatcagtaggtaaatgtgtctgattgttttaaagaatagaaagggttcttcggggaaagtttcttgggggagagcaaccttcacatgtcattttgggaaaaggaataaaaaatgattgggacacaaa

SEQ ID NO: 165740 - DNA, 7092 bp, Homo sapiens
  Payload ID: 12633
  Gene Symbol: PLCB1
  Gene Name: phospholipase C, beta 1 (phosphoinositide-specific)
  Uniprot ID: Q9NQ66
  ENST ID: ENST00000338037
  CDS Start-End: 388-4038
cactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaaccc

SEQ ID NO: 165741 - DNA, 3864 bp, Homo sapiens
  Payload ID: 12633
  Gene Symbol: PLCB1
  Gene Name: phospholipase C, beta 1 (phosphoinositide-specific)
  Uniprot ID: Q9NQ66
  ENST ID: ENST00000378637
  CDS Start-End: 4-3525
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccaggtaggactggatgggaggggtcgcttttgagagaagggtggtgtgtagccatccagttttcaggcatcacggacttgctcgtttgtccttcatcctccctttctctacattcccatcttttttttctgctaaagttcccagccacacccatgatcatttcctcatcctttctgccttcctctggtattaatttctccatcattgtgctctctcttcctgacataaatctcattcttccatattgtcttcttcctctttctccattttgtttctctattggcaaatttggcttcctttttaatctggattttctctcttgc

SEQ ID NO: 165742 - DNA, 7323 bp, Homo sapiens
  Payload ID: 12633
  Gene Symbol: PLCB1
  Gene Name: phospholipase C, beta 1 (phosphoinositide-specific)
  Uniprot ID: Q9NQ66
  ENST ID: ENST00000378641
  CDS Start-End: 515-4036
gcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatt

SEQ ID NO: 165743 - DNA, 1260 bp, Homo sapiens
  Payload ID: 12633
  Gene Symbol: PLCB1
  Gene Name: phospholipase C, beta 1 (phosphoinositide-specific)
  ENST ID: ENST00000404098
  CDS Start-End: 127-744
gcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtgagcatgtgtgttatgctatagtttgaatgttcagcccctccaaaactcatgttgaaacttaatccccaatatgacagttttgagaggtagggcctttaagaggaaattaagagcttccatgattaatgggttaatgaattaatggattatcatcggagaggaactggtggctttataagaagagaaaaacagacctgagctagcatgttcttccccctcaccatctgattccctgtgccacctctgccaaagtggagagtccccactagcaagaagacttttgccagatgtgccctctccaccttggacttcccagcctttgtaactgtaggaaatacattttgattcctatatattatacagtttcaagtattctgctatatgcatcagaaaacagagtaagactgaaaattggtaccaagaggtggggtttttgctgataacaaatatctgaaaatgtagaagcagctttggaactgggtaatgaacagaggctgaaaaaagtttatagagctagctagaaacagccaagacttg

SEQ ID NO: 165744 - DNA, 321 bp, Homo sapiens
  Payload ID: 12633
  Gene Symbol: PLCB1
  Gene Name: phospholipase C, beta 1 (phosphoinositide-specific)
  ENST ID: ENST00000437439
  CDS Start-End: 1-126
atccaggaagtggtgcagtatatcaagaggctagaagaagcgcaaagtaaacggcaagaaaaactcgtagagaaacacaaggaaatacgtcagcagatcctggatgaaaagcccaaggtaccatgatgaattcctctgtgcttttcttccatgaggttgctccatgaccatctttttgtgtctggatttgaaggttgcccatgaagattgttggttccatgtcaaactaaagcatttcttgagggtttttcttcatggcttaaaaacgttgtgccttaaagctgtgattttattaataaaataataaatcatgactgttaa

SEQ ID NO: 165745 - DNA, 1819 bp, Homo sapiens
  Payload ID: 12633
  Gene Symbol: PLCB1
  Gene Name: phospholipase C, beta 1 (phosphoinositide-specific)
  ENST ID: ENST00000439627
  CDS Start-End: 1-591
attatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagagggtggatttctgcatgatgaaattatgagactcacccgtaatacgctggaaaaactgatggccttacctcttacccatgtggtgcccatccaaagcaagatgctgtcataagttttagtagagacgggatttcaccatgttagccaggatggtctcgatctcctgacctcgggatccacccgcctcggcctcccaaagtgctgggattacaggcatgagccaccgcgcccggccggaactgcactcttcagatgactcagacaaggaaagcatgatccaacacctctaatagcccagtaatacatatgatatttgaaaggcccttcacttaccatgttaaccattcagttaaatcctccaaatcctaattctctgctgctcaaccatcagatccaaactttcaatgcccaggacggaaatcttttcaaccagcacatcaaatggcttttcctccttctatagaacttataaaaatgatcttttcagttaccattttactggtccatctgtattctattttcagtgcacttctgttcattttggaattaggaagcgtacaaattctttttatatttaattttaacattcaagttaggcatattttgaagaaaaagatattgcaatgattgcatttgtccactagagggcaggaacttacttctgtggttcattctgcactttttttttcactacccacctaagaaaaatctagtcaatgcgactgaagtactaccaccttctgaatcttctttccttgataattgcttaattggaatttaaatctttgaatcaaattaagaaactagacattcctagtttctgtttctatcacaatttccagtaccagatttttattcactcataaaaacaaataatgggggagaaataaaatattgacttctgctgattctcttgagtgggataaggaatttggtttttgcactttggcttacagatccatatagtggaattattcgatctttcaattataatatcagaaagttcaattttagtattgtactcctataggtgctttttttcatttttcagccattgttttgcttaacttatttaactttgtatgtacggatgcctttttagtgcaacagggtagttctttgagaattatgtttacatgtagacatctctatctcagcagcaagttaagttattattacggttccttaagctgctgttatcatagagtggactgctgtaatagaaaaatttagtctttagcatatagtccatattcaaatacttgttcacagtttcctgtgtgacctctggcaagttacatgacttttaataaagtttttagtaaagacttttaataaca

SEQ ID NO: 165746 - DNA, 4781 bp, Homo sapiens
  Payload ID: 12633
  Gene Symbol: PLCB1
  Gene Name: phospholipase C, beta 1 (phosphoinositide-specific)
  ENST ID: ENST00000487210
  CDS Start-End: 1-2744
aaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagtcatgacaagaaataattggcttgtgagaatcaacattgaagctggaaaaatgatggcatccgaacaagtagacacagccctagtcaaggcaataaactacactaaagacagaggagaaagactcaaagttgttctaacatgtgagtacctaggggtgctgcatgccgttgtgtggtttgtgtactgcatagttgtactcagccaaggaagtggatgaggccacagctttaacatgggctgctgtctgcccagaaggataatcttttccttattttatatctcatttcaggggttctccaacttctgaaatccatccagaaactccctgtatttgggtaacagtattataactttttgcaccagggcttttttgtttgtttgttaatattaattgatttttcttatgttctttatgaaagaataactcatccattaatgaaaccaaatgtgaacttagtgccttctgtgtagaaaaggctaggaatacatattgtgggagattcattacatcactggccttaatactacaccttctcatgttcccccttggctgtgtaactttctagtgtccatatgctctctcttggggtggccagtgtgacttgctttggccaatgggatattagcaaccatgacataacccgaggcttataaagttgcctgctcattgggacttgtttcactgttgcatcccagttattcacatcactccagctgacagccaaccaacaaacagccagacacgtgagcccaaccaagatcagaagaactgtcccactgagcatagtctaaattgctaacatgcaaatgcatgaaacagaccacagcaaggtaatcttacagcccaggactcagctgctgcaatctctgtgaaaggttctgctcatgaaacagagacaaccatgtgtggtgcctgcattcttggcctgcggggagtggaaaggagacaaagagtaaaacacggtgggaaagaagaaaaagaggttaagaaaagcaaatgtgcctactccaggtaattttgacttagggaccctgattaacttacacactaattaaaccatttccagattttgtgcagtctgaaagcagcccattttccccaacaccaggtcgctcaagatgaccacaggaaggttgtcatcttcatgtctaaaagccagttgacactcaagggtgtcatttcacttcagtgaaatgagaagcttcacagatgtgtagactctgaaaaatctaactggaaaacaatacagggaaatagcaatactaggcatcaaagcagcaaaaaaactactcaattatctgatatggggattatcaatggaataaatgtggggtttgttgtttgttgttgggattgttgtgggttttgtttcattttttagggtctcacttttctccaccaattagatctgtgctgtgagccacacaggttttgagtacatgttttgggactttatatcggtcagactttgccatggtaacactgtgtaacgagcagccccaaaaatctcagtggtggtcaaaagcaaacctttatttctcattcatgggttttcagtttgttcaggctaaaagtaaaatacacagattcttcacctgtctttcattccatgctgaaggagcaattgactgcctgggacatacttttctcataacagaggcaagggtgaaaaacaccaagtcatcttgattatgcaatcccatttttaatgtaaacaatgtcatgtctgcttctatttcattgagcaaagcaagtcatataggcaagcccaacatcagtggggtgataaagcacactctccaatggaaggaggaggggagcatgatcatttgctgaacagtaatgcaagatagcacaagacttgtctggggtgagagagagatcaaagctgtggatcccacccagtcttcaaccaaagcaatgtggctttgacctgttttctgtcttggacttgaataatactttatttgaaagaagtgttaaattgtttattaaaaaaaaagacaagtttgaaaa

SEQ ID NO: 165747 - DNA, 6458 bp, Homo sapiens
  Payload ID: 12633
  Gene Symbol: PLCB1
  Gene Name: phospholipase C, beta 1 (phosphoinositide-specific)
  ENST ID: ENST00000617005
  CDS Start-End: 1-3411
acccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaac

SEQ ID NO: 165748 - DNA, 6576 bp, Homo sapiens
  Payload ID: 12633
  Gene Symbol: PLCB1
  Gene Name: phospholipase C, beta 1 (phosphoinositide-specific)
  ENST ID: ENST00000612075
  CDS Start-End: 1-3282
acccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaac

SEQ ID NO: 165749 - DNA, 3206 bp, Homo sapiens
  Payload ID: 12633
  Gene Symbol: PLCB1
  Gene Name: phospholipase C, beta 1 (phosphoinositide-specific)
  ENST ID: ENST00000625874
  CDS Start-End: 326-3206
aatcaagcctgggcaatggcgggcgcccctcccccagcctcgctgccgccttgcagtttgatctcagactgctgtgctagcaaccagcgagactccgtgggcgtaggaccctccgagccaggactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtg

SEQ ID NO: 165750 - DNA, 443 bp, Homo sapiens
  Payload ID: 12633
  Gene Symbol: PLCB1
  Gene Name: phospholipase C, beta 1 (phosphoinositide-specific)
  ENST ID: ENST00000475958
  CDS Start-End: 1-80
cagcagatcggaagcgagttgaaactgctttagaggcttgtagtcttccatcttcaagggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatt

SEQ ID NO: 165751 - DNA, 3095 bp, Homo sapiens
  Payload ID: 12633
  Gene Symbol: PLCB1
  Gene Name: phospholipase C, beta 1 (phosphoinositide-specific)
  ENST ID: ENST00000629992
  CDS Start-End: 383-1129
gctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctgcttgctattgcttttttgttagatgctttggaataggaaaaatataacaattaaggtcctgtccccgacttcaacaaatatttcttgagctcttactatgtgcccataggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatttaacttatgaatctagctaagggaaagaaggaatagaaaattaaatgtatgaaccaattccccgtaaattgtaattttctaaacaactggattctgagcagtcaataaatacacattgagtaatctactatgtttattatatgttcaaactttcagaccaatgtcaattgcaggcaaatttaaaaggaaaatgagattcaaataacatgagttatgtttaaattagaaaaaattatctctaacaaattaaatgtaatgataattatctgaagttggagaaaactttaaaaaacctctatgctaaaactttgaaaaattattattcatagtaaagtataatttacttggatgacttatagaattagaatgctttttaaaaatctaaaaaccaaagactgtttcagagctaggaaataaatgtttctgtgaactgactatgatgtatcaaaactctgttttaaatctctgtgataatttcattcctacataacaatgactctagaaaatatccactaattagcaaaaaattttggccatattcacaagaggtattttaaacaagccacggaagaaaagggttatataaatcatagttggttctgcgtaaatgggagcatattttgtagccaagtcatttaagctagatttaattgtgctctgtaaatagatatattaccagaaacacagtggatgtcctgttgagatttctttttaaaacatgatattactgcacattgttggggataaataaggcacttgaacttgtatcctggctgacgtgatccactagaataacatattcctttagaagatgctactctttagaaatcacagttgctagcctgaagttaccctaattgttaaaaggtagtactgtatccaaagagagagacaaagcaattactgtccttctgttaacaacccaagcatattttccagtgagacccttgaaaactgttccgtgttcaaaaaattaccactttacccacaaactttctgagaactgaaaatagtttatttgcaccaaattcccttgatttaaggcttattaacttgaaaagagctcagtgacatctggaattgtataatagtcttgccacagcactggcatacggagttgcattttaacgaagaagatcaggaataaacccatgtatttgtttcaaataataaagtttactgtagttggtgggcacacatgtaatacaaagagaaattaattattttaaatttgaagaattgtataaattttactaaatactatgaataaaatgtataaaataacttctgtgtgtaacttattagtatgttgcctttcttctgtgccttacatcctgaatataaatcagaagcaatcacttttgtagttgtgattcttaatatgactaatatcaaaattctactttaaaaccaaattaagtattccgttcattatgagtgatttacttgtagttatttcatgtattccatggctaattcaatgttttatttatagtttcagaataaaaatattgacagta

SEQ ID NO: 165752 - DNA, 759 bp, Homo sapiens
  Payload ID: 12633
  Gene Symbol: PLCB1
  Gene Name: phospholipase C, beta 1 (phosphoinositide-specific)
  ENST ID: ENST00000630495
  CDS Start-End: 350-759
agtttgatctcagactgctgtgctagcaaccagcgagactccgtgggcgtaggaccctccgagccaggcttgtcccatggcctctcatagaaatcatggaccatggaagaacaagaatatggtagacatgaaggaaatgtagagggactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaacc

SEQ ID NO: 165753 - DNA, 2996 bp, Homo sapiens
  Payload ID: 12633
  Gene Symbol: PLCB1
  Gene Name: phospholipase C, beta 1 (phosphoinositide-specific)
  ENST ID: ENST00000626966
  CDS Start-End: 114-2996
agactgctgtgctagcaaccagcgagactccgtgggcgtaggaccctccgagccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgag

SEQ ID NO: 165754 - DNA, 830 bp, Homo sapiens
  Payload ID: 12633
  Gene Symbol: PLCB1
  Gene Name: phospholipase C, beta 1 (phosphoinositide-specific)
  ENST ID: ENST00000628239
  CDS Start-End: 1-695
agcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaaggttgctccatgaccatctttttgtgtctggatttgaaggttgcccatgaagattgttggttccatgtcaaactaaagcatttcttgagggtttttcttcatggcttaaaaacgttgtgccttaaagctgtgattttattaataaaat

SEQ ID NO: 165755 - DNA, 4616 bp, Homo sapiens
  Payload ID: 12634
  Gene Symbol: PLCB2
  Gene Name: phospholipase C, beta 2
  Uniprot ID: Q00722
  ENST ID: ENST00000260402
  CDS Start-End: 251-3808
acaggcccccatggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagcgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggatactggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgtt

SEQ ID NO: 165756 - DNA, 4242 bp, Homo sapiens
  Payload ID: 12634
  Gene Symbol: PLCB2
  Gene Name: phospholipase C, beta 2
  Uniprot ID: Q00722
  ENST ID: ENST00000456256
  CDS Start-End: 154-3666
ccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagcgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggatactggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaa

SEQ ID NO: 165757 - DNA, 1763 bp, Homo sapiens
  Payload ID: 12634
  Gene Symbol: PLCB2
  Gene Name: phospholipase C, beta 2
  ENST ID: ENST00000543785
  CDS Start-End: 239-838
ggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaacctggaggagcgagataaggtcggcagtggcaggcggcagtctgcagggatctggaagtctgcagcgtgtcgagggagaggaactgaaccaaaggcggaagctgccaagatgcagacttctgctctgtacagaaaagcatttttccctgtctttttagttaaataattaatttttaattacaagttgtaagcagggtcaccccatgaagcaacttgtgtgaattacaaaaaggagccctctgggctgatatggccctgagctaggcttcaagcctggccaatggagcgaatctcagcccctgtccctgcttggccagtgctcttgtgtgggtcccagcctataccccatggagtattttctcctggtaagaatttggaacgttataaataaataaaaccacgacccccattgatcacctgcccacatgaatcccaggaggagcatttaccccacagccacagctctgcagagttggtgactccttgatgcagtcagtcacagggatccaaatgtggcgttggggagaggtaggaatgggctcctgcggctcccctacagccagcaacacttacctgtggtcagcacacatccaccctccctctctcctgctgcctgagctcctcccttggctaagtcctccttatctatctgctttccttgtgtctcagtagaggctactgacccaactttgcttggagctgaagctccagagacagggaggggtttggggagatccagttagactctcctgctcagaccctctgctccaaactaagactgatgttggccttccagtgtgattctgaaagacatttaatgttttttttggggggggaaggaatgcaaaggtgcagaatccctgaataccacaaatgtacttttcatttctatttctatagatttgcctattctggtggtaaagtaaatgaaatcataaatata

SEQ ID NO: 165758 - DNA, 517 bp, Homo sapiens
  Payload ID: 12634
  Gene Symbol: PLCB2
  Gene Name: phospholipase C, beta 2
  ENST ID: ENST00000559671
  CDS Start-End: 1-262
cgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagccagatcccgcacatccttgaaggcctatctttaaaaggcccgagagccctctcctgcccacaactccatcttttcatccaaggactgtgttggtacgtatttagcagaagaattcagccctcaggtgacaacgtccattttttaagtcccagtgttgtcttcttaagaggtggaacgtctcgcacccagaaccgagattctgtctctctcttacccgctgccggcaacaaaatgtgcggctcatgaaaagtctcagtaaattctgcagctgataa

SEQ ID NO: 165759 - DNA, 4517 bp, Homo sapiens
  Payload ID: 12634
  Gene Symbol: PLCB2
  Gene Name: phospholipase C, beta 2
  Uniprot ID: Q00722
  ENST ID: ENST00000557821
  CDS Start-End: 166-3711
cagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagcgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggatactggtggggaggctgagggcagcagcccacccagtgcccctgcagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtg

SEQ ID NO: 165760 - DNA, 438 bp, Homo sapiens
  Payload ID: 12634
  Gene Symbol: PLCB2
  Gene Name: phospholipase C, beta 2
  ENST ID: ENST00000559618
  CDS Start-End: 1-225
atacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgcctgcctgacaaggtcagcatcatttgctctcctgaatttatgaggtttatttatttttctctttcctactcctattaaagaacctcgtcccagtg

SEQ ID NO: 165761 - DNA, 4197 bp, Homo sapiens
  Payload ID: 12635
  Gene Symbol: PLCB3
  Gene Name: phospholipase C, beta 3 (phosphatidylinositol-specific)
  Uniprot ID: Q01970
  ENST ID: ENST00000279230
  CDS Start-End: 128-3832
ccgggacagactggcgggcgggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccagtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcagg

SEQ ID NO: 165762 - DNA, 3946 bp, Homo sapiens
  Payload ID: 12635
  Gene Symbol: PLCB3
  Gene Name: phospholipase C, beta 3 (phosphatidylinositol-specific)
  Uniprot ID: Q01970
  ENST ID: ENST00000325234
  CDS Start-End: 76-3579
ccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagaagctgatgacggtggtgtctgggccagacccagtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 165763 - DNA, 4469 bp, Homo sapiens
  Payload ID: 12635
  Gene Symbol: PLCB3
  Gene Name: phospholipase C, beta 3 (phosphatidylinositol-specific)
  Uniprot ID: Q01970
  ENST ID: ENST00000540288
  CDS Start-End: 104-3808
ggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccagtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgagatgaggagactgaggcccggagccatctgtcgtgtgctaggccacagctaagtcaagacgtcctgacctggaggcagggcaggcctggaccctccgtggtggactgtcttcagccagcctggacctgtcccatgcctcaagaccagcgaaaagtggcagagagcccacagtgcgggctccagggcggggctgggctcgcagcagggtcggcttggcacctcttcaaggcctctcccagcttcctggctcttcccaggctgcccgcctgcatccctcctccaggggaaggcggcctcttatctgggcttatctcctgccaattgagtatcttctttgctttgtttttgctgcagcctcaggcaaacagatggggtggggaggccagggaaacaggctccggagtagggccctcctccctcagggtcaatgcaatggccccagacttcctcacttcttctgtgggacgctgccctatcccccagttctgctcactccagtgtattccgtatctaggctcctcagcagccaactcccaccttcctgactctagctggtgtccactgagggacacactccaagtcagttcccaggtcctcaaataccagctgaatgtctaacttctgggtgtgacattccagcccctagaa

SEQ ID NO: 165764 - DNA, 5430 bp, Homo sapiens
  Payload ID: 12636
  Gene Symbol: PLCB4
  Gene Name: phospholipase C, beta 4
  Uniprot ID: Q15147
  ENST ID: ENST00000278655
  CDS Start-End: 79-3606
aggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 165765 - DNA, 5619 bp, Homo sapiens
  Payload ID: 12636
  Gene Symbol: PLCB4
  Gene Name: phospholipase C, beta 4
  Uniprot ID: Q15147
  ENST ID: ENST00000378473
  CDS Start-End: 232-3795
agtaagtgagctgcaccgccaacaagatctctcacacacagacacacacacgcacacgcacacacgggcgcgcacacacacgcgcgtacacactgggtctccaggcagcggccgtcgccgcatccccggcagcagctccaggcaaagtgacagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 165766 - DNA, 5796 bp, Homo sapiens
  Payload ID: 12636
  Gene Symbol: PLCB4
  Gene Name: phospholipase C, beta 4
  Uniprot ID: Q15147
  ENST ID: ENST00000378493
  CDS Start-End: 16-3543
gtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 165767 - DNA, 5833 bp, Homo sapiens
  Payload ID: 12636
  Gene Symbol: PLCB4
  Gene Name: phospholipase C, beta 4
  Uniprot ID: Q15147
  ENST ID: ENST00000378501
  CDS Start-End: 16-3600
gtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 165768 - DNA, 614 bp, Homo sapiens
  Payload ID: 12636
  Gene Symbol: PLCB4
  Gene Name: phospholipase C, beta 4
  ENST ID: ENST00000407043
  CDS Start-End: 276-614
gggaggaggaagcggctggccgctgaggggcggcggggcccggagcgggggacgcgcagggcccggcggtgggcgggcgggtcggcgctgccccgtgggctcgctggggagccacggcggagacccccgccctcaactgaggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 165769 - DNA, 3947 bp, Homo sapiens
  Payload ID: 12636
  Gene Symbol: PLCB4
  Gene Name: phospholipase C, beta 4
  Uniprot ID: Q15147
  ENST ID: ENST00000414679
  CDS Start-End: 16-3579
gtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagc

SEQ ID NO: 165770 - DNA, 484 bp, Homo sapiens
  Payload ID: 12636
  Gene Symbol: PLCB4
  Gene Name: phospholipase C, beta 4
  ENST ID: ENST00000437503
  CDS Start-End: 241-484
acacgcacacgcacacacgggcgcgcacacacacgcgcgtacacactgggtctccaggcagcggccgtcgccgcatccccggcagcagctccaggcaaagtgacaggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctg

SEQ ID NO: 165771 - DNA, 595 bp, Homo sapiens
  Payload ID: 12636
  Gene Symbol: PLCB4
  Gene Name: phospholipase C, beta 4
  ENST ID: ENST00000416836
  CDS Start-End: 417-595
ctgtgacaagcgtttgctgtatttgttgttcgacttagggtagttgaaagagtctctctcagccactctctctggatattttgttgtggctgtgggcactgtttgcccagcctctcactttgtagcggaggggtgggactctgcgtgaaaggaccagcgttatagtccctggcttctccggctaattcatcccgaggctcctgccccttcccattctggaaggggcgagcttatcctagacctgtgactgcctctgaagttctccacctgcctcaggcgtgctctccagtgcctgtttctgactgagtgaggttgaaatcctactgactccttttcagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgct

SEQ ID NO: 165772 - DNA, 505 bp, Homo sapiens
  Payload ID: 12636
  Gene Symbol: PLCB4
  Gene Name: phospholipase C, beta 4
  ENST ID: ENST00000441846
  CDS Start-End: 176-505
gcgggggacgcgcagggcccggcggtgggcgggcgggtcggcgctgccccgtgggctcgctggggagccacggcggagacccccgccctcaactgagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagt

SEQ ID NO: 165773 - DNA, 2769 bp, Homo sapiens
  Payload ID: 12637
  Gene Symbol: PLCD1
  Gene Name: phospholipase C, delta 1
  Uniprot ID: P51178
  ENST ID: ENST00000334661
  CDS Start-End: 224-2494
cgcgtccccagaagggggcggggagagacgagggttggcgggctcagggggcgggggcgcagggcagcgggggcggggcggtgtcccgggaccacccccggcctcctcccaccgcggtccattcaggtccctgcaccgcactccgctcggaccccaggccgccggtgctgtcgctactcaagtgagtcccgcggtgcccctcccgccgcgccgcccgtcgggcatggactcgggccgggacttcctgaccctgcacggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagatt

SEQ ID NO: 165774 - DNA, 2963 bp, Homo sapiens
  Payload ID: 12637
  Gene Symbol: PLCD1
  Gene Name: phospholipase C, delta 1
  Uniprot ID: P51178
  ENST ID: ENST00000463876
  CDS Start-End: 355-2688
ttcttctcgtcccgcctcctgtattctgactccccccactcatttactttgcctcggtttcgctctcgcctcaccttcagggggcataggtcccgccgctcgtggactagctccgcctcctagcgtctgactaccccctcagcccagatttccctctcgtcccgcccctccgaagtgcgcccctcctctcgaactctagctcctccctcccattcctggactccgcccctgctcccctccaagggcgacagttccgccccccggaccagagcagagggtgttgtgagcataaaacactggaggcggcactgccccggacccggctccgcgcaggcaggggcactgtggagggccatgcagtgcctggggatccggagccggagccgctccagggagctctacctgcaggagcggagccttaaggtggcggcgctcaatggacggaggctgggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagatt

SEQ ID NO: 165775 - DNA, 546 bp, Homo sapiens
  Payload ID: 12638
  Gene Symbol: PLCD3
  Gene Name: phospholipase C, delta 3
  ENST ID: ENST00000538093
  CDS Start-End: 166-546
acggatgcccacccacgggttgacgtcgcggacaactacaccgcgggtgccgggctggggtgccggcctgtccaagcctcgaacccagaaccagttgctggggactccaggctcggctccgcctcacgctccccaggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctg

SEQ ID NO: 165776 - DNA, 648 bp, Homo sapiens
  Payload ID: 12638
  Gene Symbol: PLCD3
  Gene Name: phospholipase C, delta 3
  ENST ID: ENST00000539433
  CDS Start-End: 1-335
tagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatgggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggaga

SEQ ID NO: 165777 - DNA, 595 bp, Homo sapiens
  Payload ID: 12638
  Gene Symbol: PLCD3
  Gene Name: phospholipase C, delta 3
  ENST ID: ENST00000590644
  CDS Start-End: 11-595
gtgtgcgcccatgtctctgccggacccaggccaccggccgcagaaacgctgccacctggacgtcccccacttcgcgcacgcactctggtgcttgcatataaatagcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatg

SEQ ID NO: 165778 - DNA, 6107 bp, Homo sapiens
  Payload ID: 12638
  Gene Symbol: PLCD3
  Gene Name: phospholipase C, delta 3
  Uniprot ID: Q8N3E9
  ENST ID: ENST00000619929
  CDS Start-End: 89-2458
ctcagagccggggccgggccagagcggcgccccgctgccctgtccccgcgtgcagaccccgggcccggccccggccccccgccaagccatgctgtgcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaccaccgccactccctgagcacctctatgctgccacccccacaggcccatgaggagggacagggctggatgagtttcttgggcctctcccctcaacagggcatggacttggctaagacagccagggggtggcagcaggagatgccacagctctaaatagcccgatccctgctcctggcttaaagctgctgcgagtatcacaagactgtctgaggatgccaattcagcaggtcagcgcctccccacaacacacacacacacacacacacacacacactcacacatacacagaggggccttgaatgaggaggagacaggagtctgagggaccctcagactgccactctccaggcttggctgggctcaaggcccctgtctgctcagtagggcaaatcccaaggacacgggcttcccttcctccagccagccagccttttacacaaaggctggaaacgctgcttgggccgcctctatagaaatgccaggagagcgcactggacactaggcgacagaatctggagaaaatcctgcacccgcccctgccagcagggtgaaatgtggaggcctggtgttttaggttctgccagccaacagtgccggcactggacaagggcagaacttgacattagtccccagagggtggcctggaactgggctgggataggccttgaactggccccaagccccacagaaaccaaaacacagggctggggcagactccaccttctagcaactccaagaactaatgcagaaagtggcagtgtcccccgctccttcatgctgggagtggcgtttggctctggttaatttgtgtgtctgaaagaggataatcagaatcaaaagggcccagaaggaatgggccgagccaggcgggccgggccaggcagcccgggcatctggcactcagggctgtcagagggtcaggctgccaaactgcagcctcaggatgggaggcacagtgaggctaagtccagttttagcaaatgaagagccattagcattgcccagcccctgcagagccaggtctggccaggggctggctggggggtctgggtcaggtgagcaccagacccagggctgagtgcccatcctgcttggcttctctggtttcgtatctggtaccaagaggaaggggtgaaggctaggatgagggcccaatactgagaaggctgccttgaaagggcaagagtcttttttttttttcttttgagacaaagtcttgctcgtcccccaggatggagtgcgatggcgtgatctcggctcactgcaacctctgcctcccgggttcaagcgattctcttgcctcagcctccggagtagctgggattacaggcgcccgccaccatacccagctaatttttgtatttttagtagagacggggtttcaccatgttggccaggctggtctcgaactcctgacctcaggtgatccacccgccttgacctcccaaagtgctgggattacaggcgtgagccactgcacccagccaaaagggcaagagtctttaaggaagtgaactgggaagcagaagcaagggagaaatcacagggttttttttttgtttgtttttttgagatggagtctcgctctgtcgcctaggctagagtgcagtggcacgaccttggctcactgcaagctccgcctcccgggttcacaccattctcctgcctcagcttcccaagtagctgggactacaggcgcccaccaccatgcccggctaatttttttgtgtttttagtagagacagggtttcatagtgttagccaggatggtctcgatctcctgacctcgtgatccacccgcctcgccctcccaaagtgctgggattacaggcgtgagccaccatgcccagcctgaaatcacagctttttatcccagaggcccatgggtagaaacaacacatagggctatgttctctcagcccaaagctaagggcaggaaaaaaggcatgggccataggagcctgagtgacttggtttgggacaggagggttggggggctttagaggggtcaggcaggtcctgtgtcctctcagtttccctggaaaggggcttggaggcaccagtcatggacctgaaaggatcagggggtcagggaatgggtaagttccagaggatgagaagagggggaatgggaagtcttaaacacagctactggggcccagcaacttgccatgttaaaatgcacccctagtgactcaaagaaccacccggccagtggtgcaggaggagagatgtggcacctgggcacagtgggaaggcacggggcctgcacctccaccagaggagccactgctgacctggaccaagggggctgctctgtgcccagctagggaagcctgggccggctcctgtgctgaggtgctcaggtgctggctgagagcccagttgctgctctaacttggagtgaacctgggtcaatagcagctcgtctctggcgggtgggaagggtctgacaacaccaagtttgccctggaagaagggcagccttaaaggaaggcctttggaagctggcctggtgctgtgggcttgagggactttgtgtccaagccctgtcgtcctggctccagcctaggctccagcactccatttcttccactgccacctgctgaccaggaataccaggacagaaggttttgttcagctgctttctttattagaaacaagtgagatgtattgagcag

SEQ ID NO: 165779 - DNA, 3232 bp, Homo sapiens
  Payload ID: 12639
  Gene Symbol: PLCD4
  Gene Name: phospholipase C, delta 4
  Uniprot ID: Q9BRC7
  ENST ID: ENST00000450993
  CDS Start-End: 340-2628
cttctctccccaccccacccccactactccctcacattgaccagtgtcctgggcctttaagagttggatgggctggactggagagagctcacacctctccccttcttactgcttccctccggctataacttgccagtcacagcagccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgtggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtgtgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 165780 - DNA, 556 bp, Homo sapiens
  Payload ID: 12639
  Gene Symbol: PLCD4
  Gene Name: phospholipase C, delta 4
  ENST ID: ENST00000415854
  CDS Start-End: 261-556
agaagcaagggagtagacaaaatgattctcttctttcttgcccctcagagagacctgagacaccctgaatcccactgtaatctccttggtgccattggtaactctgccaaagtccatctctaggtgacatgaagtctcttagaaattgaggaccaaattgcgctctgcagctctgggctacttcccatctcattttgtgtccctattttcgtatctgtattagagaggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccg

SEQ ID NO: 165781 - DNA, 3225 bp, Homo sapiens
  Payload ID: 12639
  Gene Symbol: PLCD4
  Gene Name: phospholipase C, delta 4
  ENST ID: ENST00000432688
  CDS Start-End: 243-2627
agagaaaagtgaggctgagcagagggacacgcatgctactgagttctgaacccaagtgtcctcccttctggaccacagtctcaaaattctcaaaggagatgagactcagagccattgcgaattagtggagtcaaaagagggaaccaactggaagaggtgatggggagaagggatgaggagaaggaagagaagaggagagactgacctaggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgtggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaaggttgtgacgtgcccgctgttttgtccgtctatctgttgtcagattgtggcccaggctcctatttccaagcctgagtcccttctcttgtcccggcagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtgtgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaa

SEQ ID NO: 165782 - DNA, 2738 bp, Homo sapiens
  Payload ID: 12639
  Gene Symbol: PLCD4
  Gene Name: phospholipase C, delta 4
  Uniprot ID: Q9BRC7
  ENST ID: ENST00000417849
  CDS Start-End: 186-2474
gtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgtggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 165783 - DNA, 548 bp, Homo sapiens
  Payload ID: 12639
  Gene Symbol: PLCD4
  Gene Name: phospholipase C, delta 4
  ENST ID: ENST00000458239
  CDS Start-End: 1-370
ccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaaggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagactt

SEQ ID NO: 165784 - DNA, 649 bp, Homo sapiens
  Payload ID: 12639
  Gene Symbol: PLCD4
  Gene Name: phospholipase C, delta 4
  ENST ID: ENST00000457773
  CDS Start-End: 1-334
tccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctcc

SEQ ID NO: 165785 - DNA, 578 bp, Homo sapiens
  Payload ID: 12639
  Gene Symbol: PLCD4
  Gene Name: phospholipase C, delta 4
  ENST ID: ENST00000446503
  CDS Start-End: 206-415
agtcacagcagccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaagtctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggacctctctgtccatggccaga

SEQ ID NO: 165786 - DNA, 591 bp, Homo sapiens
  Payload ID: 12639
  Gene Symbol: PLCD4
  Gene Name: phospholipase C, delta 4
  ENST ID: ENST00000444453
  CDS Start-End: 206-415
agtcacagcagccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaagtctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattg

SEQ ID NO: 165787 - DNA, 7992 bp, Homo sapiens
  Payload ID: 12640
  Gene Symbol: PLCE1
  Gene Name: phospholipase C, epsilon 1
  Uniprot ID: Q9P212
  ENST ID: ENST00000260766
  CDS Start-End: 635-7543
cgctgggcaacgtgggcaacgcggcgggcggcgggctcgcgcggcgggaggggcagcggcggcgcgcccgggctctacctcccgggctctgcctcccgggctctgcctctcgggcacttgcctggctcctgcgcgttcctgggcatcggctctgcagctgacacacagtagcggggacacccgacgccgctagcgacaggcgcgcggacggctggtcccagagggacgctgcgcttggggacgccggcgagactcgccaggagccaagaggaaacaggaatcattcaaactggattttaaaatcattgcaaatcagtgatggatcagaagttgcagagtgcaatcccgagtaaaagtcttcaaaaaattttgcttcaggtaacagaggaaggaaaattgatctaccaccttaaaaccctgatctagaaaaaatatatattcatgataggaagttataactaagaaaatttatttgcctcttaatgctcctgaatgaaaggaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 165788 - DNA, 6514 bp, Homo sapiens
  Payload ID: 12640
  Gene Symbol: PLCE1
  Gene Name: phospholipase C, epsilon 1
  Uniprot ID: Q9P212
  ENST ID: ENST00000371375
  CDS Start-End: 1-5985
atggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtatagtaagtcattgcaccatcctggaacagggcttaacttaaactactttgtaaggaaggcataattagtacaatgtcttttatcttttccaacaggaggatgtcccttgaaggcaggtaggaatgggaccttaaaacaggaaaagggctctgaagatatgtgtaacatgatatgctattgaacaccgcctataaagaaaaagggaaagaggctgggcgtggtggcgcatgcctgtaatcccagcactttgggaggccaaggcaggcagatcacctgaggtcagttcaagaccagcctgaccaacatggagaaaccccgtctctactaaaaatacaaaattagctgggcatggtggtgcatgcctataatcccagctactggggaggctgaggcaggagaatcacttgaacttggaaggcagaggttgcagtgagctgagatcacaccattgcactccagcctgggcaatgagagtgaaaactccgtctcaaaaaaaaaaaaa

SEQ ID NO: 165789 - DNA, 12024 bp, Homo sapiens
  Payload ID: 12640
  Gene Symbol: PLCE1
  Gene Name: phospholipase C, epsilon 1
  Uniprot ID: Q9P212
  ENST ID: ENST00000371380
  CDS Start-End: 236-7144
atctaccaccttaaaaccctgatctagaaaaaatatatattcatgataggaagttataactaagaaaatttatttgcctcttaatgctcctgaatgaaaggaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaattggaatttcatatatttttcacatgtcacaaatactcttgttttgactttttttcaaccatttaaaaacttaaaaactattcttaattcaggggccatacaaaaacaggtggcaggctagatttggcccaaggaccttaatttgccaacacaactaagagaagagaactgggaacaaggagcacaaagatctgaaaacaggaaaggaagtttagccatacattttatggccgagaattagaagcttagaattagaagctttggggcatttcaagtgtaaatatgtcctataacataagagtcattaaaattcaatttagttcctgtattgtgtaccacagtgcactcctctttaggatttttttacatatagaaataatattgggttttttttaaggttattgcctattcagttaatagggttgctttaaaaaaggttattgcttaatcatagattagattactcatttttggttttcaaaatgaatttagaatgacgtataatttaatatctactgaattgcaatgtcttaacaagaaacctaacaattttttaaagcaaaagtagattgagttggcgtttaaatttattttgcaaggtttgtactgacactatacttatatatttattatacatcgctctcttgatattgccatggattagaagcattagttctcagtacttgaagacaaacttctaaaaagaaaatatatgctctgaacatctgaaatgggctagactttcaagtaaaattgcttcatttctcattaactgaagagctattgatccaagtcatacttgccatttaatgtaaattatttttaaactttgctgtacaaaaccattaagtgtaaaggattcttcatattcttagtatgaagcaaattatgaattttaaaaatgaaatatgtattcctctaaaacccaaacttttatctttccattggtatctttgaattttaagacacttttcttcaaattacaaaacactaaaactcactcctaaacttcactttgagaaacttttttaaccaattataaaaataaaaccatccccatgtgtttcttgcatattctaaaaacagaagtgttaaaaatacaccacacaggctgggcagagtggctcacgcctgtaactccagcactttgggaggccaagatgggcggatcaggacagagaatgaggccatcctggccaacatggtgaaacccaatctctactaaaagtacaaaaattagctgagcgtggtggcacgtgcctgtaatcccagctactcgggaggctgaggcaggagaatcacttgaacctgggaggtggaggctgcagtgagccaagatcgcaccaccacgctccagcctggtgacagagcgagactccgtctcaaaaaaaaaaaaaaaaaaaaaaaaaaaaaaaaaaacaccatacagctttcatgtcattgaaagttcttactgggtcaaagccttaaggctagaactaccattttcttgtcaacagaattcaggctattccagtttgatgtaatctatacagtagtacagttttaagtcaaatattcattctaacaaatgcacaatgctgctccattttaaaaatattccggaaacactttatcaagcctctataagtgaacatgccaaacagtttgccctaccacgtgttgaaaactgagttgctggtctaagtggctagaggccaaatgaaaactgtgcagagtaacaagatgaaaagactcgtctctttaggtttatcacatttgattctgatgctaagcgctgccccactcctcctccatgacctttaacacaggtgtatgttttacaacataaatctgagactgaagttgagaccaggttgtttagcaagtgagagaatccagcctactgcctaggttgcatcccaatttagttgtttatcacattttgaggtgaaagtacatacttcattgtatttgagtctttgggattacagaaagaacacattgtttcaaaatgtaaagagttggctgggcacagtggctcatgcctgtaatcccaacactctgggaggctgaggtgggtggatcacctgaggtctggagttcgaggccaacatggtgaaacccgtctctactaaaaatacaaaaattagctgggtactaaaaatacaaaaattagtggtggtgggcacctgtaaatcccagctattggggaggctgaggcaggagagaattgcctgaactcaagacgcagaggttgcagtgagtggagactgtgccactgcactccagcctgggtacaagagtgagactccatctcaaaaaaaaaaaaaaaaagtaaagagtctagtctactattatacacaaatggccagcacaatctgatgttggctgaaaatatttaagttttatttaaagctttctgaattaaacagctatattatgccaagtgaaagaaattatcctaaatagccactatgactatacccattaccatttcacactttttaggccaccagaaatctgggtagcaaactcttctcattaaagttgatgtggacaagaatctaaatatgcaagttggggtcattacaaaattttaagaagcatcactgaaagtgaagagaaaggagcatgaattctgtcactctattcagtgatgccaaatctgtaggaatgatcctatctgggtagaaagtgccctttgaggggtaaagcttcttttcatgtcatcattagcaagtaaaagttatttacaaattctccagttgggagtcaatatgaagtctagactcaacaaaagttgagttacaagtgacttgtttttaatcaaacttgctttcttttatgggaggcttttatgcctcccatctcaatacctctggagacactggaagctcattaatgaaagtgggccctctatgatatgtatcaatttaccttttgctaactacatcgtccccttcctttcttctctcctcttccaatatctctatagacttctgtcctctgcccagagacccacaggccttgcttaattctggaaagttatcagggcttgcttactggcccaataaaattgaattaactctaaaacacaaaactccacatctatgctcccatgctagtaaagaagagtaggattttcctggctggtgtctttgatcttacattggcagcctgcagggaaagtgctctcatggtgaaagtctctgaccccttttcagttgcttatatatcagcagtgaggccagaaaagatatacctgggaccccaaaaaagttagagagaaaagggagattgtctcttatacagagtctagacttgggtcaatattccccatgatccattgttaataatttatgtgttctctgccatccttatgtagcagcttcctaaaagcaatccttggctgatggctatggattctgacataggaatacctgaaatgagtccctttgaaacacatactgagtctctatgattaccaagttattcttttttttttttttttttttgaggcaaagtctcactctgttgcccagcctggagtgcagtggtacgatctcgactcaccacaacctccacctcccaggttcaagtgattctcctgcctcagcctcccaagtagctgggactacaggtgtgcgccatgtccgtctaattttttttattttcagtagagacgggggtttcactatgttggtaaggctggtctcgaactcctgacctcgtgatccacccgcctcagcctcccaaagtgctgggattacaggcgtgagccaccacacctggcctacctactcttatacatctcttagattcaaaacatactatgcacaagcctgtcaccaaacagatctctgaaaccttccctattgcagatgacataggtctctaaacttttgacacaagtaattctaacactgaattgggtactgtcgcatttttcaaaagcgttatgtggatgatttgactcagcatggaagactgaggttgtcttacacccattatttcccaccccactcttaagtgccagcatagtgctaaacacacagtaggtgctcattatttgtctagttaaaaaacaaattaaggctgtagcttaatatagcctcaggatatgtgtgtgcctgtgtgtgtgtgtgtgtgtgtgtgtgtgtgtgtgtgtgtgtgtttaaacataagcttacatataagcgtatgtaagttaatgcacaaatatatttcctcaaattcacataggatactcaaatatagatgtataattttgtagtcccactgtgattctccatatgtataacaagaaaattaaaggcataatacagctgtgaaatagctgatgagtttctattttaagctgatttttcaccagaagtatagtttctgctgccaaagtaaagtataaatgtatttgtatatgtgtggaaaataaataatttgtgacatgta

SEQ ID NO: 165790 - DNA, 6500 bp, Homo sapiens
  Payload ID: 12640
  Gene Symbol: PLCE1
  Gene Name: phospholipase C, epsilon 1
  Uniprot ID: Q9P212
  ENST ID: ENST00000371385
  CDS Start-End: 70-6054
accctgcacgttgcaggatttttcactgtgatttgagattgggcttcattcagtgggtcgtggtgattaatggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactg

SEQ ID NO: 165791 - DNA, 6128 bp, Homo sapiens
  Payload ID: 12641
  Gene Symbol: PLCH1
  Gene Name: phospholipase C, eta 1
  Uniprot ID: Q4KWH8
  ENST ID: ENST00000334686
  CDS Start-End: 75-5042
tggaaaaaaggaactgtgtgcagtaccgcaggcattttctggtggacaacagtgtgtttcatgttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 165792 - DNA, 6168 bp, Homo sapiens
  Payload ID: 12641
  Gene Symbol: PLCH1
  Gene Name: phospholipase C, eta 1
  Uniprot ID: Q4KWH8
  ENST ID: ENST00000340059
  CDS Start-End: 1-5082
atggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 165793 - DNA, 6196 bp, Homo sapiens
  Payload ID: 12641
  Gene Symbol: PLCH1
  Gene Name: phospholipase C, eta 1
  Uniprot ID: Q4KWH8
  ENST ID: ENST00000447496
  CDS Start-End: 1-3009
atggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagtacaaatctgaataggaaacaacttaagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 165794 - DNA, 6413 bp, Homo sapiens
  Payload ID: 12641
  Gene Symbol: PLCH1
  Gene Name: phospholipase C, eta 1
  Uniprot ID: Q4KWH8
  ENST ID: ENST00000460012
  CDS Start-End: 359-5326
gagaaagcaggttgtggcggcggcgccctgctcttccccgctcgtctggggcttctgctggctagtggggagaagtgctcttctaggggggcttttctggcccttggcaggggtttggagttggagtcacaggggccaataactcatcaccccagcacttcggaggtggctccttgtgccacggactccgaggagtccttcagctactgaacactcaaagctgaggagggcaatttggttttgatgctgtgccagaaatcttctgacaatgagttactggaacttggaaaaaaggaactgtgtgcagtaccgcaggcattttctggtggacaacagtgtgtttcatgttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaaca

SEQ ID NO: 165795 - DNA, 3525 bp, Homo sapiens
  Payload ID: 12641
  Gene Symbol: PLCH1
  Gene Name: phospholipase C, eta 1
  Uniprot ID: Q4KWH8
  ENST ID: ENST00000494598
  CDS Start-End: 378-3422
ataatgccttgagggctttaacgcgctgcacgaagcatgcatgtctcatacccaaagtagccacagcgcctgcattcccacaatagcggcagccccgagcagatgcttccagcgtgcttatctggctgtgcttttcactttgggacaaagttctataatcatatctcatggatttattttctccacactataaagcctgaattgtgaagatctcatcatgccataaagggcagcatgagccaagttctgggggctgctaaggatttctttgccttttttccccccaccctttttggaaatgtgtatcaggaaaaggctttgcctttagagagaaattgtactgctcttgccaataatgtgtaatagtattaaatttaatggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagactctagcttttgcaggccgactgagcaggctaaagcagaaatgtgcaaagtgcctttccccagacagttagaatgtgtaatgaagatggaaatttccgagacctgaatccccaaacccagactgatctctcttctcttcttgaatataaaagtaagctggcaagatttaaaaaactgaacccaaataaatattcatcatttttttcttc

SEQ ID NO: 165796 - DNA, 3781 bp, Homo sapiens
  Payload ID: 12642
  Gene Symbol: PLCH2
  Gene Name: phospholipase C, eta 2
  ENST ID: ENST00000278878
  CDS Start-End: 1-3718
ggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgc

SEQ ID NO: 165797 - DNA, 4837 bp, Homo sapiens
  Payload ID: 12642
  Gene Symbol: PLCH2
  Gene Name: phospholipase C, eta 2
  Uniprot ID: O75038
  ENST ID: ENST00000378486
  CDS Start-End: 275-4525
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 165798 - DNA, 4837 bp, Homo sapiens
  Payload ID: 12642
  Gene Symbol: PLCH2
  Gene Name: phospholipase C, eta 2
  Uniprot ID: O75038
  ENST ID: ENST00000419816
  CDS Start-End: 275-4525
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 165799 - DNA, 5450 bp, Homo sapiens
  Payload ID: 12642
  Gene Symbol: PLCH2
  Gene Name: phospholipase C, eta 2
  Uniprot ID: O75038
  ENST ID: ENST00000449969
  CDS Start-End: 162-3551
cacgggcgggcgcggcagggcagcgtgtggggctgcgatcggcatgggctctgcgcgcggggtgcccctgctcgggctggggctcaggggacgccgggggccagcacagggcccggtgtccctcgggccgtgccggtaactgggattggcacccgccggccatggaagagcctgggcccccaggtgggctcagccaagaccaagtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccgttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccc

SEQ ID NO: 165800 - DNA, 568 bp, Homo sapiens
  Payload ID: 12642
  Gene Symbol: PLCH2
  Gene Name: phospholipase C, eta 2
  ENST ID: ENST00000609981
  CDS Start-End: 236-568
gccctttgctgcggcagctttctgttctccctggctccctgcacggaactgagctttggtgtgtgatgcgctgctggcccaggctacaccccgacaagggacaccgggggccccgggagcagagagacctcagagcagcctcctcctgcctcctgtggacggccggccccagctggtgatcccagccagtcccagctttcagttgctgcccccaccgacagtcctcagtccctccatgatggctcccccgacagccggcccccttcctggcccagctcttccgcctgaggacccagggccggatccggagagcaggtggcttttcttgagcgccaacattctgcccgtggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggc

SEQ ID NO: 165801 - DNA, 4837 bp, Homo sapiens; identical to SEQ ID NO: 165797
  Payload ID: 12642
  Gene Symbol: PLCH2
  Gene Name: phospholipase C, eta 2
  Uniprot ID: O75038
  ENST ID: ENST00000620687
  CDS Start-End: 275-4525

SEQ ID NO: 165802 - DNA, 4837 bp, Homo sapiens; identical to SEQ ID NO: 165798
  Payload ID: 12642
  Gene Symbol: PLCH2
  Gene Name: phospholipase C, eta 2
  Uniprot ID: O75038
  ENST ID: ENST00000626246
  CDS Start-End: 275-4525

SEQ ID NO: 165803 - DNA, 5450 bp, Homo sapiens; identical to SEQ ID NO: 165799
  Payload ID: 12642
  Gene Symbol: PLCH2
  Gene Name: phospholipase C, eta 2
  Uniprot ID: O75038
  ENST ID: ENST00000627854
  CDS Start-End: 162-3551

SEQ ID NO: 165804 - DNA, 5285 bp, Homo sapiens
  Payload ID: 12643
  Gene Symbol: PLCG1
  Gene Name: phospholipase C, gamma 1
  Uniprot ID: P19174
  ENST ID: ENST00000244007
  CDS Start-End: 198-4073
gagggcgcgcggaggacccgccgccgccggtgtgaggcggcccgtcctggctcccttgtccgggaagcccgcccaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcatcaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttc

SEQ ID NO: 165805 - DNA, 7395 bp, Homo sapiens
  Payload ID: 12643
  Gene Symbol: PLCG1
  Gene Name: phospholipase C, gamma 1
  Uniprot ID: P19174
  ENST ID: ENST00000373271
  CDS Start-End: 406-4278
gccgctcgtggccgccgggctgtgtccggggccgcgtgagaaagctctgcgggactgagggctgggtgggtcgaccgggaacggcgcgcgctcccgccgccatcgcgcctccgtccccgcctgcggcctgtctgggggtcgcggggcgcaggcgcggcgggccgacgggcgggggtcctccccacgggtgcgcgggcgcctttgttcccggcgccgaagcggggtggggcctcagggcagccccgccccgccgcgctgaggccccgccccgtgtccgcctgcaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcatcaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttcctttgacttgtatgctctttcgggggctcaggaaagcctgttgcatgggacatgctcactagaaacagtcgccagatgattattctgcagtagaagcaggtaggaaatttctggaaatttctcaggttaagcagcaagagctgtaacccctcctctgggctaacaggagttgtgggtccactctctcctgcccaccctctgagggtgtgtctgagcagagtacatcctgcctgggttctttgtggccagccagttttggtggtgagctggaaacaaccagagcccctttccagttccacagaaacctctcctttcaaaaatgttgcattcagttcgttaacactgccaggtgccattctgattgcctctaggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacagcgatagtgctcaggttcttgtgtgactttcttttacagcttcacagtcccagttcatagagaggagggtggctttttcccatacacaagaaggtggtgggtgggaattcacctgggccctcatgatccatgtttcctctctaggtttttatggcctggagagaaaggtttcctatcagagaaggaagaggactgtgtaggcccttctgttagggcccatccacgttggttaggacgtccttggcgtgtttgttagtgttgacccttttagttttcatcaatacgtatctctatttgctgaacaagtgtctttctggaacacaacctggggaacagacagctctgcctttcttaaggcagctttgtagacctgaggctcacctctcttgggctctgtaagacattgcctttgcctcactgcaaatgttttgattgttcttcctagtggaaaacgtgccaactctcaagcaaatttaaagatcattttcacttcaagattcctccagacctgacaaatgttgattgacccagaaggcagagtgtttgttggtggggaagacccttacttggggccgaatgctttggcatcaggagttgtttgccccatcccatgcatgcaggccgtgtccctacagtgcgacagctcagggttatgacctgtggagtctcaaccctaacagcacattagcaccacttggggagcttctgaaaaatactggtacccggggccttagcataggtattgttcaaaacctctcaaggtgatttaaatgagtaacaagggttgaaaaaccctgattttggcagcacaaaccaaaagagcaggcagggccgggagagggaagtcagtggtaccagaaggtagatgggctcccttgcaggctccttgttctcctgccatcaccagtagaaccttctggctgacagaccagggacaagtagactgggttcaaagtgacagacctttcactttcaacagctttggctcagcagacatgtacacatacaaagtagagcctacaaggtcaggggcattctgcccccgccacaggactaaagactgccctgcgggaagatggcaggagcagtttctgacctcagttgagtatctgtggccatgagcagaaaaggcaggggtctgcctcctgaccaagcacatcttgaacatcacctgagagcttgaacatcactaaggacctagacactcacttgtctttcaacttgagcccatcactcaccatgtgagttctgttgagggtgggtagaaagcaaataggttcaggttatcccaccagactaactcggtgaatgaaaggatcatgccttcttcacattttaattaaatggatcaagcaca

SEQ ID NO: 165806 - DNA, 880 bp, Homo sapiens
  Payload ID: 12643
  Gene Symbol: PLCG1
  Gene Name: phospholipase C, gamma 1
  ENST ID: ENST00000599785
  CDS Start-End: 1-153
gatgttgctgccgactcacaggaggagctgcaggactgggtgaaaaagatccgtgaagtggcccagacagcagacgccaggagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagaccaactcttcagccagtgcatgcagggctctggaggtgatgccagcaggatctggagg

SEQ ID NO: 165807 - DNA, 865 bp, Homo sapiens
  Payload ID: 12643
  Gene Symbol: PLCG1
  Gene Name: phospholipase C, gamma 1
  ENST ID: ENST00000608885
  CDS Start-End: 1-660
cttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagaaacttctctgttgaaggactgcgtccccattcaaagaggtcagatttgtgggcaggcaagagctcaggaatgaagaaccaaaaaggaggctctcaacccctctccaaggccagacgctctctgtactcccattaacttcacaaccaagtgcagacgctcgaccaactcttcagccagtgcatgcagggctctggaggtgatgccagcaggatctggagg

SEQ ID NO: 165808 - DNA, 1005 bp, Homo sapiens
  Payload ID: 12643
  Gene Symbol: PLCG1
  Gene Name: phospholipase C, gamma 1
  ENST ID: ENST00000607954
  CDS Start-End: 1-327
ctgaagacaggatacagagcagtgcctttgaagaacaactacagtgaggacctggagttggcctccctgctgatcaagattgacattttccctgccaaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcaggaaacttctctgttgaaggactgcgtccccattcaaagaggtcagatttgtgggcaggcaagagctcaggaatgaagaaccaaaaaggaggctctcaacccctctccaaggccagacgctctctgtactcccattaacttcacaaccaagtgcagacgctcgaccaactcttcagccagtgcatgcagggctctggaggtgatgccagcaggatctggagg

SEQ ID NO: 165809 - DNA, 956 bp, Homo sapiens
  Payload ID: 12643
  Gene Symbol: PLCG1
  Gene Name: phospholipase C, gamma 1
  ENST ID: ENST00000609257
  CDS Start-End: 1-400
cttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggaaagcctgttgcatgggacatgctcactagaaacagtcgccagatgattattctgcagtagaagcagaccaactcttcagccagtgcatgcagggct

SEQ ID NO: 165810 - DNA, 544 bp, Homo sapiens
  Payload ID: 12643
  Gene Symbol: PLCG1
  Gene Name: phospholipase C, gamma 1
  ENST ID: ENST00000612731
  CDS Start-End: 1-397
ccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggacttggcagctgaaatctctgggccctttcaacacagttgaaaggcccttctcttcctgaagctctgtttccatagttggctgtgctgggatggaacaaaaatgacgccacacaaaaaatttaagatagatccggttccgtggatgacatgaactgatgatagccagtatcaaacagcgatagtgctc

SEQ ID NO: 165811 - DNA, 3819 bp, Homo sapiens
  Payload ID: 12644
  Gene Symbol: PLCG2
  Gene Name: phospholipase C, gamma 2 (phosphatidylinositol-specific)
  ENST ID: ENST00000359376
  CDS Start-End: 1-3759
atgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgccgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaatgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagtccagctgtaccaggagaaatgcaacaagaggttaagagagaagagagtcagcaacagcaagttttactcatagaagctggggtatgtgtgtaagg

SEQ ID NO: 165812 - DNA, 454 bp, Homo sapiens
  Payload ID: 12644
  Gene Symbol: PLCG2
  Gene Name: phospholipase C, gamma 2 (phosphatidylinositol-specific)
  ENST ID: ENST00000563375
  CDS Start-End: 1-136
ggacatgcaggacatgaacaaccccctgtctcattactggatctcctcgtcacataacactggactgctgggacgggcccgatgggaagccggtcatctaccatggctggacgcggactaccaagatcaagtttgacgacgtcgtgcaggccatcaaagaccacgcctttgttacctcgagcataagaagctgggcccccgaggcgatgtggatgtcaacatggaggacaagaaggacgaacacaagcaacagggggagctgtacatgtgggattccattgaccaggatccagtacccggtgctgccgtgcatttaggttgtcctgactccttcgtgtcctccaactgggggtcgttccaccagaaaccttatttttcagactttaatgctgcctctatccctttacctaatgtgtatatccattttgagtatatttttacatgtccgttctta

SEQ ID NO: 165813 - DNA, 1282 bp, Homo sapiens
  Payload ID: 12644
  Gene Symbol: PLCG2
  Gene Name: phospholipase C, gamma 2 (phosphatidylinositol-specific)
  ENST ID: ENST00000563193
  CDS Start-End: 1-535
gaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagatgtcccttgagctgggtggaggtgttgctgtgagacaatgaaattatggacgtcttttcgcacttggtgaaaacctttcaatgaaggcatatgatttctccatcgcagcattctcccctgtggggtcctagcccttctaagtgccaacctccatcaggcagatggaaggagctggtattaacagacactgtgcagtggcagcttacactctgctttgagagtttgctttcatttgcaggacataggtgcttatggttgtgagctgacagtcattcatcgaacattatctcattcatgactagaggaagttttttctggttaaaatagggctggaatcatctaacacctatagggctagaactctgtaatcaaacattaatgcattaatgttttggcagcaaaagccatccttattggtattaagagggatttaagaaaatgattgcaagcagcgttcattcgaatggttcagattttgctgtcagttacattttgataccaacttactaggtagcctttgttgtaaaagctttttagctgttatgttctagtaagggtgtgtggatcaggatcggggagtgagctgggtccacgcttcccaggagtgatgaggctatgatttacttgagctggaacatggttaaggattttatttttatcatcgtcactttattttcacatttgccttcatttctattgagtgacgtgatttcctatttatggaagtgacatagctgcctttagaataattttgtttcatagtaaatgccatgcacaagc

SEQ ID NO: 165814 - DNA, 912 bp, Homo sapiens
  Payload ID: 12644
  Gene Symbol: PLCG2
  Gene Name: phospholipase C, gamma 2 (phosphatidylinositol-specific)
  ENST ID: ENST00000565054
  CDS Start-End: 434-912
tccctccaggggcccaagagccactggtactcagtgtctgggtgggggcaggggggatttttgttctcccagcacctgcggctgttgagaccagagaagctggtggtcgaccacagcctggggtattagttcacccctagcttctccccagcgagaccccagggcccttgggcacaggggattaagcctctatctgcttacgtgcaagcggaagaaataggcccagagagcaacagtggcgggtctgcagtcacacagccaacttgcgcttgtggcagtggcaaggttgaagttctgagggtacccctcactcaagctccaggcgtcaggaaaagaacattccacgaagtccatctggaagacggtcctttccctgctgcccccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacag

SEQ ID NO: 165815 - DNA, 8707 bp, Homo sapiens
  Payload ID: 12644
  Gene Symbol: PLCG2
  Gene Name: phospholipase C, gamma 2 (phosphatidylinositol-specific)
  Uniprot ID: P16885
  ENST ID: ENST00000564138
  CDS Start-End: 215-4012
gaggatcacgtggcgcggcgccgcggccgaagcagaagtagcgagcgccggcggcggagggcgtgagcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgccgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaatgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgatcaattaagccttctgttgcacgacctgtgcagtgaacaggatttcttttctggccaagaagattctacctctaatgatccaggtaactgatgtccatggaggatgagctggaaatgtaagaaactattcatgagattctgaaaaggattttaactcaaaggcaaatgattccataagggcccaaagagaagccctacccacaggcagcctgctcagttcaatgtactttaactaccaccggctgcctgctgcagtccacaagaaaatggctgagtgatgggatctgttcattaagacaatttctaattaatggtgacagcttgttttgtgactagagttactgggatggagggtaggaatcttggggcctctttgttttaaaaagcccatcagagagaccagagccgtgctgcaggggcaggttctcacttgcccctggctctgccagctgctgggaggctctggccccactagtccctcatggccctactgaactggctgggaggctgctggaatggcccttggtccacagctctccacaggcaagaggtcaactgctgcttgaaagaggtagacaaaagttaggttgatggcgaaatgtctctgggttacccagtcttctggagcagcaagctgagctttaatgggctaagcattagggtgttacagaaaatttcaaatgcagccatctcccttggggcagatctacctagttcatgacagtatgtgcggctggccagggctttacacctctgcatcttaagttgttaatacataccaataatgtaatatggctttttaaaggagaggagagtgctgggttgggaagggaggtggttggtagagtcacaacttctcaatgagtgaatttacagctgatgggaaaaggagtgtaactgtgaaaaacgatggctgtggtggggaagaacaaaccagcagtaagcctgatgtttgatgtggatggaactggcccctagaaacccatctgaccctcctcttgttacccgaaatgctgggcttagtatgcatgtactgctgaaaagcagggcagaacaaatcaggctctgaccagaagatccttctggtcccttcactctacaaaaacttactgatcacctccacatgccaaatacagtgccaagatttgggggtgtggatgtttaaacaaaaagctgtgggtctcatcaatcatctccatccacaagctcctaaaagaaagccatttacctcgcttgaagccaggaacacagggaacagcagtctggccaaggaagggctgttatctggtgctatcactccagttactcctccaactgggagctgctattttatttggcagtcagcaactgaagaaagaacattcctcttagtggcagatgttcaaagcaactttcaagaaaggctaggtgagaaaggcactgggatgagtgctgcaggcactctgtagccagggccccattagcctttggccaggtagccaccagaacctatttattgcacctggcatctcccccaacccctctcagctctgttaggacttccacacagcagagctcaggtgttgctgtcattacctcctttcagctcctcacttcattctactttaaagccacagtgctaaggcctgcatcccctttctgcccaaatgggttttttgctaccatatcaaagaacctgacatatggcggcataggaagcagaagctaagcctctctccagctgctgctgtgtaaaatccatgcgtggccaaagagaagtcaggggattatgacataaatggtgctgggaagaaccctctgcctaaaactgtctccttctcctggtgctacaaccggaatccaccatgagagagtactttcttcggttctttcctcctgtccttgacagagtaacacgttaatctggttcttggtggtgttagggactgattctctcaggaaaggcacacatggtatgatggctcttcccagagtctatgtgatgctacataacttcagtatctagctgagacatgcttcctacatgactgttaaagcacagccaatccaggccaagaagactagtaacaggcacattctgaaagatggaagcagcactgatagatcaaaaccaccactgcatatgtattacactgtttttgttcaccattttcctaagtgtgttatttagaatattggttattacaaggaaaaataaagtggggaggctggttaggccttgtgagtttgggaaacttaggttataaaaactaaataaagtttttctactgtgagactagatgtgcaggagtgaaaggtgtagagggtcttgttttccaaattcgatctcagaatctttttgccagaagtgtctcatgggacttatctatagtggaacacatttgaagacctactgctctattaagaaggcagccggacaacatgttctaatacttcgtatgctttgtgacctagttaaaatctaaacttaagtcgccatggccagtggcctttagattaagctagccttacccctgggagtataccagagctttccaaggaatacacagactccagtactctcaggggagcagtgttcagagcctcatcttcctgttatattcttctctaagattcatctgcctgagaaaatgcccttttctcaccttacaaaagaaaatatggctgtctccacctctagtcttactgtagagcatgtcccaaggtgtaaaaattcaaaatgtggatatttggaaagtgaaagacttatcaacagggcacaaatctttttgcaaatggattttccaagtttttctggtggttccaaattttttgctttcaacaaagtgggaggaacagcctgtagatttctgagtctcttagcatgtaactacaaaggggttggaagaattcagtgattctgctatcataaagcttccgttcccattgatgtatctgtgtgaacaaggatcaacatctccataaatgaaattgaaaacggaaaatagaattgatgatgaactttggctcaatcttaagatgttatcaatctacatagatgaaataattgtggagaaaagccctctttatctcattaagtgatacatttccaaagaagttttactatgtttaataatttagtgaaatttgggctatgtgtttattgattcagctcaatccagaggaaaattttaaaggcttacagccttaggattataggatactatataatacttttggtacagagatagaattaaataacataaaaatcaaaaatttattaggctaaaattttgagggagaagtggtatgaaaatacaaattcaaggagtaaaaggaaaagtggggcattccttgctactaaaaattgccttgttccaggtaagactgatcataaaaaaatggccctgttcataaaatttttaaaaagatcatagtatctatcaaataacttatattaagaacctcctgggctaaatttaaaaagtaatacaacagttttatttaaacatgtagtgtctacggtatgccagcactttgcagctatttataatgagaaattttagatgtcaatatagcaatgtgcaagaagatagagattttcaaaattcacttaagagtatctgagcataaaatgttaagattgctgatcggatgtgagggcgatctggctgcgacatctgtcaccccattgatcgccagggttgattcggctgatctggctggctaggtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagattgctgatctagggccactaagtgatgaattgtatttggaagcaaaaaggatggctaaaaaggacctcaacccttttgactttaaaaggaaaatagcttaaccttcaacctgtgtgacatttaactttttgaacccaaccgtaaaagctatcttctaaccaacaaaaagttaataattagatttggaattatacagaattagaaaattggcatttaaaaatactcaataatttgtccctggtttttaattttcaaaatattttctttttgaagagccagattccagtgatcctgcctctcagaaatttccacatttcttatttttcattaggccttaagaagctgcatttgtaaacttgtgtttcattattaaagcttaatttattttttatataaatagtatgtgctttgtgtacatagagaattaagtgaatgagtcacacagatgttggctgttgttaatgtgaaaattaaacagctgtatcacattttgaaaaataaaagtttcatctgaatgaatatagcaa

SEQ ID NO: 165816 - DNA, 2148 bp, Homo sapiens
  Payload ID: 12645
  Gene Symbol: PLCZ1
  Gene Name: phospholipase C, zeta 1
  Uniprot ID: Q86YW0
  ENST ID: ENST00000266505
  CDS Start-End: 265-2091
acaatgggaattcagaccaaaaggaaaaaatgacagtcacctgacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 165817 - DNA, 2113 bp, Homo sapiens
  Payload ID: 12645
  Gene Symbol: PLCZ1
  Gene Name: phospholipase C, zeta 1
  ENST ID: ENST00000318197
  CDS Start-End: 223-360
gacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagtaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatg

SEQ ID NO: 165818 - DNA, 653 bp, Homo sapiens
  Payload ID: 12645
  Gene Symbol: PLCZ1
  Gene Name: phospholipase C, zeta 1
  ENST ID: ENST00000539072
  CDS Start-End: 156-653
agtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaaattcagggttaatttgctcacctttctggaagagagaactaaaacagagaggtcagattcaggatgacttcagaggtggaaaaattaacctagaaaaaactcagaggttacttgaaaaattagatattcggtgcagttatattcatgtgaaacagatttttaagacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaag

SEQ ID NO: 165819 - DNA, 374 bp, Homo sapiens
  Payload ID: 12645
  Gene Symbol: PLCZ1
  Gene Name: phospholipase C, zeta 1
  ENST ID: ENST00000536023
  CDS Start-End: 1-304
ggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatgaatgtctttatgt

SEQ ID NO: 165820 - DNA, 525 bp, Homo sapiens
  Payload ID: 12645
  Gene Symbol: PLCZ1
  Gene Name: phospholipase C, zeta 1
  ENST ID: ENST00000534932
  CDS Start-End: 199-468
aaaatgggaaatttttggataatggtggttctggatatattttgaaaccacatttcttaagagagagtaaatcatactttaacccaagtaacataaaagaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 165821 - DNA, 626 bp, Homo sapiens
  Payload ID: 12645
  Gene Symbol: PLCZ1
  Gene Name: phospholipase C, zeta 1
  ENST ID: ENST00000535429
  CDS Start-End: 217-378
agtgtggtgcccagccaaccagctatacctcttttgaagattttaagaacttagcctcctgaacagtcttcttcgaaaaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatat

SEQ ID NO: 165822 - DNA, 1667 bp, Homo sapiens
  Payload ID: 12645
  Gene Symbol: PLCZ1
  Gene Name: phospholipase C, zeta 1
  ENST ID: ENST00000540270
  CDS Start-End: 1-1237
gtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatggtcaaggtaatatggtcattattccagcatgagccaattagtttactatttctgtgggcatagactgcaccctagattgctatgtggtaaatgtgctcttgtgaccacaggtgaaccatagaaaacatagatatagtataattagaaattcatcagtgcttctggaaatcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 165823 - DNA, 773 bp, Homo sapiens
  Payload ID: 12645
  Gene Symbol: PLCZ1
  Gene Name: phospholipase C, zeta 1
  ENST ID: ENST00000543242
  CDS Start-End: 380-773
agtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacagattcaggatgacttcagaggtggaaaaattaacctagaaaaaactcagaggttacttgaaaaattagatattcggtgcagttatattcatgtgaaacagatttttaagacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgc

SEQ ID NO: 165824 - DNA, 722 bp, Homo sapiens
  Payload ID: 12645
  Gene Symbol: PLCZ1
  Gene Name: phospholipase C, zeta 1
  ENST ID: ENST00000541966
  CDS Start-End: 494-722
agtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacagattcaggatgacttcagaggtggaaaaattaacctagaaaaaactcagaggttacttgaaaaattagatattcggtgcagttatattcatgtgaaacagatttttaaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgg

SEQ ID NO: 165825 - DNA, 997 bp, Homo sapiens
  Payload ID: 12645
  Gene Symbol: PLCZ1
  Gene Name: phospholipase C, zeta 1
  ENST ID: ENST00000539207
  CDS Start-End: 234-371
gacagtcacctgacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagtaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaaggtagaaaaatcaggcccagttttagatatcagcagaagcagaaatatagtttcctcagttttgataaagctgtgaacttgtattctgagtgcccttgtgaaaggatgccgttgtttggagattgactgctgggatggagcacaaaatgaacctgttgtatatcatggctacacactcacaagcaaacttctg

SEQ ID NO: 165826 - DNA, 1398 bp, Homo sapiens
  Payload ID: 12645
  Gene Symbol: PLCZ1
  Gene Name: phospholipase C, zeta 1
  Uniprot ID: Q86YW0
  ENST ID: ENST00000539875
  CDS Start-End: 99-1346
tgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagcca

SEQ ID NO: 165827 - DNA, 646 bp, Homo sapiens
  Payload ID: 12645
  Gene Symbol: PLCZ1
  Gene Name: phospholipase C, zeta 1
  ENST ID: ENST00000543219
  CDS Start-End: 1-450
gatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaagcatctgagatgtgcctaggaaacaggtcttcctgaagcagaagggtggtggctaattttggatcatgcagcgctttgcggaaggagaagttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 165828 - DNA, 1612 bp, Homo sapiens
  Payload ID: 12645
  Gene Symbol: PLCZ1
  Gene Name: phospholipase C, zeta 1
  ENST ID: ENST00000538330
  CDS Start-End: 383-1555
ttacaaacctctccctatctccagttgtggcagccgaaaatgtctccagacattgccaaatccctcctgtgaggcaaagtcgtcccagtggaaaaccagtagcctgtagacatggggtagaaaaatcaggcccagttttagatatcagcagaagcagaaatatagtttcctcagttttgataaagctgtgaacttgtattctgagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggtaaggtggaggaatgggaagaagaagtggcagatggagaggaggaggaggaggaggaggaggaggaggaggaggaggaggaggataaattcaaagaatcagaagtattggaatctgttttaggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 165829 - DNA, 797 bp, Homo sapiens
  Payload ID: 12645
  Gene Symbol: PLCZ1
  Gene Name: phospholipase C, zeta 1
  ENST ID: ENST00000540421
  CDS Start-End: 1-797
ggctacacactcacaagcaaacttctgtttaaaactgttatccaagctatacacaagtatgcattcatggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgg

SEQ ID NO: 165830 - DNA, 5125 bp, Homo sapiens
  Payload ID: 12646
  Gene Symbol: PLCL1
  Gene Name: phospholipase C-like 1
  Uniprot ID: Q15111
  ENST ID: ENST00000428675
  CDS Start-End: 399-3686
atcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaa

SEQ ID NO: 165831 - DNA, 6665 bp, Homo sapiens
  Payload ID: 12646
  Gene Symbol: PLCL1
  Gene Name: phospholipase C-like 1
  ENST ID: ENST00000435320
  CDS Start-End: 399-683
atcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaagatgggactgtgtagttgcaggaaaacagctcagagtttccactgattcttcattatggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaa

SEQ ID NO: 165832 - DNA, 5979 bp, Homo sapiens
  Payload ID: 12646
  Gene Symbol: PLCL1
  Gene Name: phospholipase C-like 1
  ENST ID: ENST00000437704
  CDS Start-End: 1-3057
attttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaa

SEQ ID NO: 165833 - DNA, 3083 bp, Homo sapiens
  Payload ID: 12646
  Gene Symbol: PLCL1
  Gene Name: phospholipase C-like 1
  ENST ID: ENST00000487695
  CDS Start-End: 48-3083
attgcagggtctttctgatgtgatttcttatagcacctctcaagaaaatgaagaataaacttcaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaag

SEQ ID NO: 165834 - DNA, 2416 bp, Homo sapiens
  Payload ID: 12647
  Gene Symbol: PLCL2
  Gene Name: phospholipase C-like 2
  ENST ID: ENST00000419842
  CDS Start-End: 1-2114
aaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagataagaaagacaggaaggaggagtatttttgtgcctcagactcccataatggtatgagtaccctcctccttctcctccctcacactgcatgtgatttggaagaaaagtgtctgctggcccccagggaatggaaggtgctaatctttgctgtcttcaacatccaagcatgtggccattacacaggtggcagagggcaggggaagtcttagctgccgcactggatccctcacctcagaagtaagacaactgtttttctctaatagatagttggacaaaaggactttgaaaaaattagccagatgtagaatccctgttgttttgcccctacgtctgaataaaagcaatgacttgtgattgtt

SEQ ID NO: 165835 - DNA, 3940 bp, Homo sapiens
  Payload ID: 12647
  Gene Symbol: PLCL2
  Gene Name: phospholipase C-like 2
  Uniprot ID: Q9UPR0
  ENST ID: ENST00000432376
  CDS Start-End: 254-3259
gaaacgtacctaagtattattggacagccggagtattttacagtggttgctgctcaggaaatttgagtgaaggactgcaaaagaggagcaaagcagacccgagagagaaggcagcagtgctcccctgtgacgtgctccatcaccgggcagggaagacaccgctgccacctctccacagccttgttcaagagcactggaaattgatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatga

SEQ ID NO: 165836 - DNA, 4147 bp, Homo sapiens
  Payload ID: 12647
  Gene Symbol: PLCL2
  Gene Name: phospholipase C-like 2
  Uniprot ID: Q9UPR0
  ENST ID: ENST00000615277
  CDS Start-End: 82-3465
ccgcgcgcggcggcccgaggcggcggcggggacgcggggacgcgaggacgcggctttgtgcaggcgggtcgcggggcgcccatggcggagtgcggccgggggggcgccgccggcggggccctgcccacctccccgggcccggccctcggcgccaagggcgccctgaaagccggagtgggggaaggcggtggcgggggaggtcgcctcggccacgggcgggcgcgctatgacagcggcggggtttccaacggagactgcagcctcggcgtgtccggggacgaagcccgggctagccctaccaggggaccccgcggcgttgcgctcgccccgacccccagcgcggtcgtctgtaccctcccccgggagagcaagccgggcggcctgccccgccggagcagcatcatcaaggatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgat

SEQ ID NO: 165837 - DNA, 1906 bp, Homo sapiens
  Payload ID: 12648
  Gene Symbol: PLD3
  Gene Name: phospholipase D family, member 3
  Uniprot ID: Q8IV08
  ENST ID: ENST00000356508
  CDS Start-End: 124-1596
gtcaggcggggatacagcctggaaggtaatgcatgtccatggtacacaaattcacaagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 165838 - DNA, 745 bp, Homo sapiens
  Payload ID: 12648
  Gene Symbol: PLD3
  Gene Name: phospholipase D family, member 3
  ENST ID: ENST00000359274
  CDS Start-End: 213-745
ctggctgagctgtgtggtgtgggggcacctgagggcggaggagccacctagaatataccccctgtcccagggctgagaaaagccaggcacaaagacctggggctccgctgacctcatccagcgctgcctttcttggggtgtctacagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgca

SEQ ID NO: 165839 - DNA, 873 bp, Homo sapiens
  Payload ID: 12648
  Gene Symbol: PLD3
  Gene Name: phospholipase D family, member 3
  ENST ID: ENST00000392032
  CDS Start-End: 488-873
ggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaaggtaatgcatgtccatggtacacaaattcacaaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccct

SEQ ID NO: 165840 - DNA, 1966 bp, Homo sapiens
  Payload ID: 12648
  Gene Symbol: PLD3
  Gene Name: phospholipase D family, member 3
  Uniprot ID: Q8IV08
  ENST ID: ENST00000409419
  CDS Start-End: 192-1664
ctgcgcgcggctaggaggggccgtcaggcggggatacagcctggaaggtgcgtgtggggctgggtctcggagtgggagacgtggagtgcagaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataact

SEQ ID NO: 165841 - DNA, 2140 bp, Homo sapiens
  Payload ID: 12648
  Gene Symbol: PLD3
  Gene Name: phospholipase D family, member 3
  Uniprot ID: Q8IV08
  ENST ID: ENST00000409735
  CDS Start-End: 358-1830
aggaggggccgtcaggcggggatacagcctggaaggtgcgtgtggggctgggtctcggagtgggagacgtggagtgcaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 165842 - DNA, 2115 bp, Homo sapiens
  Payload ID: 12648
  Gene Symbol: PLD3
  Gene Name: phospholipase D family, member 3
  Uniprot ID: Q8IV08
  ENST ID: ENST00000409281
  CDS Start-End: 333-1805
ctctttataatttagtttccatagaagttatatgtgcatttaaaaaaattcaatgctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 165843 - DNA, 2180 bp, Homo sapiens
  Payload ID: 12648
  Gene Symbol: PLD3
  Gene Name: phospholipase D family, member 3
  Uniprot ID: Q8IV08
  ENST ID: ENST00000409587
  CDS Start-End: 398-1870
cggctaggaggggccgtcaggcggggatacagcctggaaggtgcgtgtggggctgggtctcggagtgggagacgtggagtgcaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacaatgcccggagtttcatctacgtcgctgtcatgaactacctgcccactctggagttctcccaccctcacaggttctggcctgccattgacgatgggctgcggcgggccacctacgagcgtggcgtcaaggtgcgcctgctcatcagctgctggggacactcggagccatccatgcgggccttcctgctctctctggctgccctgcgtgacaaccatacccactctgacatccaggtgaaactctttgtggtccccgcggatgaggcccaggctcgaatcccatatgcccgtgtcaaccacaacaagtacatggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcgcccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgta

SEQ ID NO: 165844 - DNA, 443 bp, Homo sapiens
  Payload ID: 12648
  Gene Symbol: PLD3
  Gene Name: phospholipase D family, member 3
  ENST ID: ENST00000596682
  CDS Start-End: 199-443
ggcggggatacagcctggaaggtgcgtgtggggctgggtctcggagtgggagacgtggagtgcaggtaatgcatgtccatggtacacaaattcacaagaacaccccacacagtgcccacttttgttctgccagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcga

SEQ ID NO: 165845 - DNA, 503 bp, Homo sapiens
  Payload ID: 12648
  Gene Symbol: PLD3
  Gene Name: phospholipase D family, member 3
  ENST ID: ENST00000602131
  CDS Start-End: 145-503
aggaggggccgtcaggcggggatacagcctggaaggtgcgtgtggggctgggtctcggagtgggagacgtggagtgcagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcct

SEQ ID NO: 165846 - DNA, 544 bp, Homo sapiens
  Payload ID: 12648
  Gene Symbol: PLD3
  Gene Name: phospholipase D family, member 3
  ENST ID: ENST00000599685
  CDS Start-End: 335-544
tcgtccgcggccgctctaccccaacaggccgccaccagcgagagtgcggccataaccatcacgtgaccgcccaccgacaccagcgagagtgcagtcgtaaccgtcacgtgaccgcccaccgtcggcccggcgctcccctccgcccgaagctagcaagcggcgcggccaatgagaaaggcgcatgcctggcccccgccggcctgcagtctagccgtagtgcgcctgcgcgcggctaggaggggccgtcaggcggggatacagcctggaagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggccc

SEQ ID NO: 165847 - DNA, 710 bp, Homo sapiens
  Payload ID: 12648
  Gene Symbol: PLD3
  Gene Name: phospholipase D family, member 3
  ENST ID: ENST00000492243
  CDS Start-End: 1-364
caaccagcgcccagccccctgctatgacccttgcgatctatccaacacacccatggacggacagctgagcactcacctcccagcccttgctctccggcaccgtatggctgatagcatcccccaccccccagagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacctgggcagtgccaacatggactggcgttcactgacccaggtcaaggagctgggcgtggtcatgtacaactgcagctgcctggctcgagacctgaccaagatctttgaggcctactggttcctgggccaggcaggcagctccatcccatcaacttggccccggttctatgacacccgctacaacca

SEQ ID NO: 165848 - DNA, 580 bp, Homo sapiens
  Payload ID: 12648
  Gene Symbol: PLD3
  Gene Name: phospholipase D family, member 3
  ENST ID: ENST00000598962
  CDS Start-End: 497-580
gtgcgcctgcgcgcggctaggaggggccgtcaggcggggatacagcctggaaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcg

SEQ ID NO: 165849 - DNA, 804 bp, Homo sapiens
  Payload ID: 12648
  Gene Symbol: PLD3
  Gene Name: phospholipase D family, member 3
  ENST ID: ENST00000594908
  CDS Start-End: 164-804
ggcggggatacagcctggaaggtgcgtgtggggctgggtctcggagtgggagacgtggagtgcaggtaatgcatgtccatggtacacaaattcacaagtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattctggcggttgtgggcttcggagccctgatgactcagctgtttctatgggaatacggcgacttgcatctctttgggcccaaccagcgcccagccccctgctatgacccttgcgaagcagtgctggtggaaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatcgctgtgagcaagcccagcgggccccagccacaggcggacctgcaggctctgctgcagagcggtgcccaggtccgcatggtggacatgcagaagctgacccatggcgtcctgcataccaagttctgggtggtggaccagacccacttctacct

SEQ ID NO: 165850 - DNA, 536 bp, Homo sapiens
  Payload ID: 12648
  Gene Symbol: PLD3
  Gene Name: phospholipase D family, member 3
  ENST ID: ENST00000600948
  CDS Start-End: 404-536
gtcaggcggggatacagcctggaaggtgcgtgtggggctgggtctcggagtgggagacgtggagtgcagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtatcccccagccttgagggaagatgaagcctaaactgatgtaccaggagctgaaggtgcctgcagaggagcccgccaatgagctgcccatgaatgagattgaggcgtggaaggctgcggaaaagaaagcccgctgggtcctgctggtcctcattc

SEQ ID NO: 165851 - DNA, 332 bp, Homo sapiens
  Payload ID: 12648
  Gene Symbol: PLD3
  Gene Name: phospholipase D family, member 3
  ENST ID: ENST00000599353
  CDS Start-End: 1-332
aaagcattcctgagggcctggacttccccaatgcctccacggggaacccttccaccagccaggcctggctgggcctgctcgccggtgcgcacagcagcctggacatcgcctccttctactggaccctcaccaacaatgacacccacacgcaggagccctctgcccagcagggtgaggaggtcctccggcagctgcagaccctggcaccaaagggcgtgaacgtccgcatggtggacatgcagaagctgacccatggcgtcctgcataccaagttctgggtggtggaccagacccacttctacctgggcagtgccaacatggactggcgttca

SEQ ID NO: 165852 - DNA, 327 bp, Homo sapiens
  Payload ID: 12648
  Gene Symbol: PLD3
  Gene Name: phospholipase D family, member 3
  ENST ID: ENST00000486134
  CDS Start-End: 1-214
ggtgactgaacgcgccacctacatcggaacctccaactggtctggcaactacttcacggagacggcgggcacctcgctgctggtgacgcagaatgggaggggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggatggccagtggctcagcagaggccccgagatgctctccttcctcccagctgctgccccggca

SEQ ID NO: 165853 - DNA, 6515 bp, Homo sapiens
  Payload ID: 12649
  Gene Symbol: PLD4
  Gene Name: phospholipase D family, member 4
  Uniprot ID: Q96BZ4
  ENST ID: ENST00000392593
  CDS Start-End: 169-1689
agaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcccggtgcctctgtgtgagtcccgcgcgggcggcccttcatcctcttgccaagggcccgcctctatgcgcccgcccctgcgaaactgcgccgcgcgaccgccgtggcagcgcctcagctagccccgggtccgcgagaacctggggcggggcggggcggggaccagacgggcctcccaggcggagcgaaccctccacctcccaccccgcgccgggctgccgcgctccggaacccaaattcccgccccgaggctgccgggggaagcgagaggcgcggagcccacgcccgggactccagcggaggaaacgcagaccaaggcgcagcgccgcgcacccaccgccagggggcagctcctacggcgccggacaggggcggcgcgggaggggagcggggctgaggggaccgggagggcgggaggggacctgcgactgaggggacagggagggcgggaggcgacccgcggctgagtgagggaagggcgggaggggacccgcggctgaggggaccgggagggcgggaggcgacccgcggctgagtgaggggagggtgggaggggacccgcggctgaggggacagggagggcgggaggggacccgcggctgaggggaccgggagggcgggaggcgacccggggctgagtgaggggagggcgggaggggagcggggctgaggggaccgggagggcgggaggggacctgcgactgaggggacggggaggatgtgaggcgatccggggctgagtgaggggagggtgggaggggacccgcggctgaggggacggggagggcgggaggggacccgcggctgaggggacggggagggcgggaggcgacccggggctgaggggacggggagggcgggaggggacccgcggctgaggggacaggtcctgcgtgcgggctggggagacaggcgggcgagggtaggggtgcacaaggctgtgtggtttgtgggctgttgtgcagggtgggtccaagcatgtgggggcaggcttgtcctggggatgcagtgcccagggttggtggatggggctgagaggaccagcatttgagctggagggcaggaaggtgactccagtctgagaccaggacttggatgcagctccactggaactcaccctatcctgggagccacctgggcacctgtcctgcagatgcaggatttgaacccaggtttggcaactcagttcccactcttctgctatgaatgctgggtcagaaggattctcaaaacaccctggcttatctcacctgatggttcctgaccaagaccacagggtaccctcccctggtggaggtccatggggccatgctaggctggagttcagggatggctcagcggtatgaaggagcactggatgctgaatggaccccagggtgccccgaatgctctcccggtcttgaggcaccactttcctacccttctctacttctctccttttcctacccttctctacttttttctttcctacatttgtgtccctgccacactgtgaactcagccatatcttcctcttccctctttgctttggggaaagctagcaaagttcatctcaggtacagtacaagttacttttctgttcgattagtgacctcatacttcccccatctaaaggacaccttagacttcagcattctgtctgtgcagaaatctcctacacccatcctgcctccctgcccaagcttgtgaaaagcttgctgcagatgctgcagggggatagggatccacatagccctgcaaggccttcaggagcttctgggggctgctttgtgtgtgagctgcacttggccaagccaagctctggcagttgcagtggctgctccctgtggcttcctatccctcattcatgctccatatctcctcagtaaccatctggcaaaaagcttcgtggcaacacctggctcagaagccgatatcatcccagactaagctctgccctccagggttgcacgtgtgggtttgctccctggttcttggccttatacctgaatgtgtctcagagcacttggcctgctctcttggcctgccaactatgttctaggagggctctgtgctccaggctgtgatttggacaactggctggtggccctcagccagtgaaaggcctctttccacacacctggggactggcagtcacacctcagtggcactgacagaggcctgcttcaaggcagatgcctattccaaaggaaatccagcttgacaaggcttgggagaccccaggagggtgccacaatgtggccccttctgggctatagcagacagactctagaatggctcccttgacccccacctgctggtatgcatgcccttgtgtgatctcaccttgagtgtgtgcaggacctgtgccttgttgtaaccaatagaatacagaggtaaggggatgtcactcctgtgacaccttgtgatcatgtgacataagattataacattatcaaggaatagcagtctatcccttgctagctttaaaaagtgagctgctaggctatgagctgtcctatgaagaggcccatgtagcagggtactggggttgcctccagcccccaactagcaagaaactggggccctcaatcatcccatccacaaggagttgagtgtggctagcaacaacgtgagcttcagaagtggctgctttcctggtcatacctgaaggggagaccacagccccagctgacatcttgattgtagcctaatgggaccttgagcagagaacccaacaaagccacacttgggctcctgatccacagaaactgggagatcataaatgtgtgttgttttaagttgctaatttgtagtgatgttcttatgcagcatagataactcatacacagagaaccaaggccacgcgagaaccctgtgggggcccctgctgctcagccactcctcacatgctgggacagctgtctctctggcctctagcaccaaggtccccactatcccaggccttgactcttggatcagagagggacaaaagccccatggagccaagcagactcctccccctgggctgcactcacctagcttgtctggcacacacaagttggagtagagaaggcaggaagccctgggaagggagagggtgatggccttgcttaactgggatgagtgtccaccaaatttcccttcccacttcccctgctcatgagcccccaggggacctgtgtcagttcactttctagaggcttctatgtgccctaacttggatgacacccacgggcctccccaactcagcacagggaacatatgcccatggtggcatggggaaagaacccagcctctcccctgcccaggctcctgcaccccatagctgtcacccctctggaacctctcagggcagcacgagtggtagcctcggagtggccttcaccctccaggcactgcggtcctccagattggctcacagcccagctcttgctcccatatccacagccatgagagcagccacctccccagggggccataagcgcttctcaccaggagcccacctaggccaggagggagctgggggcaagttccaactgcccccttgaacactgcatacccatgaatctggcaggggcatctgggaagagatttgaccactgaaagactgtagggaaacccttgaacctcaatccgctacgccacgtggatttgcttcctgtgggctgcccaagagcgcctctgtggtgaaggaagcttctgaggatgggccactaaagatggccaaggtcacctttctgtgctgtccccactctgcactccatctcccatcccacactgcctccagctggagggagggagggagggttgtacgtctgtgtccctgccacactgtgaactcagccctatcttccttgtcttcctcacagcctctggctcagaggaggacctggacaaatggatgataggtaggcaaccacccaaatgttcctcattgactgttctctagagctgcttagtagagaccaggagtgtgtgggaggaaagccctggtaaacttcgaccctgagacagaagacctcagcagccttcagcatgggatgcagcactttctttattgcccatccagggaacagccaagccagctccatctgcattctggctgcagcgtgtacattaggggactcaggggccacagtgtgggaccgtgcacactggcaaggcactggcggatgctggcaggccagtggacatggatagatgagaatgacaactcacagatgtcctagcttctgctggcccagctgccagccactggccatcacccttttgcccagcatgtgtgcattgtcacccaaaacatcttgaaacttgccattagtgaggcattcaacaaagaagtaagctaagtgagtaggaaacagtgtttcctggaatataccgcactctgcctgaaataggaaaactatgtttgccgggaagcagcagcagcaggaaagaagttataccaaaaacgacttgtacaccacagacattataaccctttcctcaaagaaacagtcatgttctgttgggtattatggacaggtctctggaaatttatctaataaagaccaacaaacttccccagcagt

SEQ ID NO: 165854 - DNA, 2007 bp, Homo sapiens
  Payload ID: 12649
  Gene Symbol: PLD4
  Gene Name: phospholipase D family, member 4
  ENST ID: ENST00000540372
  CDS Start-End: 193-1734
aggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagagctggagctgctggtgatgccaggctgccctgtgcagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcc

SEQ ID NO: 165855 - DNA, 883 bp, Homo sapiens
  Payload ID: 12649
  Gene Symbol: PLD4
  Gene Name: phospholipase D family, member 4
  ENST ID: ENST00000557573
  CDS Start-End: 113-883
agagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaag

SEQ ID NO: 165856 - DNA, 667 bp, Homo sapiens
  Payload ID: 12649
  Gene Symbol: PLD4
  Gene Name: phospholipase D family, member 4
  ENST ID: ENST00000553861
  CDS Start-End: 169-396
aacgtctctgtggacgtggtgagggcgtgctcccggccgggcgtgggaaaggcggccctcctgccgcccttcctgacgcgctgcctctgctcccctaagaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggctt

SEQ ID NO: 165857 - DNA, 2830 bp, Homo sapiens
  Payload ID: 12650
  Gene Symbol: PLD5
  Gene Name: phospholipase D family, member 5
  ENST ID: ENST00000314833
  CDS Start-End: 101-244
attctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 165858 - DNA, 2729 bp, Homo sapiens
  Payload ID: 12650
  Gene Symbol: PLD5
  Gene Name: phospholipase D family, member 5
  ENST ID: ENST00000366545
  CDS Start-End: 228-557
gtaggtgccgcaaggagccggcgagcggagcgcccgctcgggaccgcagccgccgggcgacgtcgccgccgcaccgggcacttctgtctccccggagcagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcac

SEQ ID NO: 165859 - DNA, 3018 bp, Homo sapiens
  Payload ID: 12650
  Gene Symbol: PLD5
  Gene Name: phospholipase D family, member 5
  Uniprot ID: Q8N7P1
  ENST ID: ENST00000427495
  CDS Start-End: 127-1551
ggtgatacgtttgtgccacatgaaacattctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 165860 - DNA, 3305 bp, Homo sapiens
  Payload ID: 12650
  Gene Symbol: PLD5
  Gene Name: phospholipase D family, member 5
  Uniprot ID: Q8N7P1
  ENST ID: ENST00000442594
  CDS Start-End: 228-1838
gtaggtgccgcaaggagccggcgagcggagcgcccgctcgggaccgcagccgccgggcgacgtcgccgccgcaccgggcacttctgtctccccggagcagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 165861 - DNA, 490 bp, Homo sapiens
  Payload ID: 12650
  Gene Symbol: PLD5
  Gene Name: phospholipase D family, member 5
  ENST ID: ENST00000459864
  CDS Start-End: 70-490
gggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagg

SEQ ID NO: 165862 - DNA, 1353 bp, Homo sapiens
  Payload ID: 12650
  Gene Symbol: PLD5
  Gene Name: phospholipase D family, member 5
  ENST ID: ENST00000467561
  CDS Start-End: 396-989
cggagcgcccgctcgggaccgcagccgccgggcgacgtcgccgccgcaccgggcacttctgtctccccggagcaggttcctttccctccctgtcccctctcgtcccccttctccccgtccgtccccctccgcccccgcccccgcccccgcccgcacctcgccctccctccttccgccccgcgcctcccgcgatcgccccctcccgcccggccgcgctcccagctggcgctcagcaccccgcgctccccgcgcccgctcgctcctccagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcggtgagttgttttccctttctcctccccttctccttcttcctccaaaggct

SEQ ID NO: 165863 - DNA, 8721 bp, Homo sapiens
  Payload ID: 12650
  Gene Symbol: PLD5
  Gene Name: phospholipase D family, member 5
  Uniprot ID: Q8N7P1
  ENST ID: ENST00000536534
  CDS Start-End: 243-1853
cacctcgccctccctccttccgccccgcgcctcccgcgatcgccccctcccgcccggccgcgctcccagctggcgctcagcaccccgcgctccccgcgcccgctcgctcctccagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaacaccaggtcctcccccagaatccacaaaggaaaacaaattcacagcttcctgttgcaaatgtggatgaaaagagcacagccccacagaaaccctggtggagatctggattgtcaacatttcaatagaacattgcgttgggctgctttggcatgaataacatcaacacaaaactagacgtcgtgctagagctggttcttcaggaccataatatacatgtattttcagagcaaggaaacactcagttattctttttcatttctggagacttgatttctaaatgccaaaagagtgatcgaggagcctgtgaatcttatccaatggatttacttaatatagaatggctatgttggttatccagtgagtgatcacattacttcccttcttgttatttgcaagtattgcttcactagatatttaaccagttgatcaagagagctggaaggaagctgtatttttaagggtagcatggttttatgactaattgggagattctcactgaaattcttcatcaataatagccagtccctaagactctaaatatttaccatatacacaatccatatttgagttgggagttataactctgccagttatcccaataaagtaaacgtggctttggtgatgattttaaaaagaaagcagcctgggtgcggtggctcacgcctgtcatcccagcgctttggaaggccaaggcaggaggattgcttgaggccaagagtttgagaccagcctgggtagcatagcaagatcctgcctctaaaaataaataaatacagaaaggaaagaaggaatcagaataggagtggagacaaacctaccaagttcacactcagacaaacaaaagcgacctgagttggttttaaaaaggacatctaaagggagaaaaaaaaaccaaataaactaaaatttgttagttctcaagttgtcccctgaagtattcatccacagccatgggacactcataggcttggtgtcatggggccccttcactgtcactatctgctgtatgtgctacgagaagagaatgtcatccattacggaatgaccatcattgccatttccttttgaggcctggcaaaatgctatcaccaggagccgcatcccaggcttttctgccaagcagcagcagcagatgcctaccagacacagcaagcccctaatcaggggagtctgggcagcggtggtgactccatggggccacactgtccttctgtggcagccagaaaagtgacccccataccaagagtgtcagaaatgggttcatgtctcccaagagaacatttcattctgcagaactttctttcatttggatgctttagctatccctctagagacggctttcctttcttttagacttgtttctgtgctaaacaaactatcaacctccattcccccccacccctaaatatcccaggaattactttccaggagggaaagaatgcaaaacaaaaacaggttaatttgacaccctctggtggatgtccatgccagaaattatgaggagcagggtgactactccccattaacattcctggatttatttcccaagaggcaaaaaggaaaacaaacacaattagagactatatcttggatttcagtaccactaacactaacttagtgccttatgtatcctcaagtgttgattttaaacaatgacttattctatgagaacacttctctctcctgtggaattcaaatgaccttccgatgggcctaccagttgaaaacttccatttgagcagtgacagtttttatgctgcctgttctcttcccaagccccatcacctttatccacccccccgccaaatcaaatcattgcacacaccatcaaagatcaatactgtgggcctccactgcattgtcactggccactagcctatcaaataattgaatctctgcttgtccaaccattggagaggaagtggaagagtgagatgacatccatgctttgtaaacaacaagctttaggtacctgaacctgatagaaacaaggaatgctgaaaatgtccccactgacttaaaagaatgctgtaaagagatgctttgcagacttcctaggtcctgtggcacagagaatgaaaaccagcgtctttaacaagtcaaagcagacaaagaaacaaaaggtctgcggatacactttgcacctgtgtaactctgggcaccattcgggccctctctgtgctactgtttgtctcatgtctgaatggttcttggtgagaggggtctgatcacatttttggttgatctcaccctttgaaaaatgtgggggattttttttgaaatgcagttaatggtttaagtgcctcgatgaacctgggatggatagaagctcatttcccaccagcctgtggctatactcagtgactctgattcattctgtttgtttttaggaacttttattgaactaaattccaaggggggagaaaagaccataagaatttcttgataagatcagatccagggtctatctgtctcaggaattctatcctacaattaacttttttttttttccacacgtatgaccactggtgtgtgtttctgtgtccaaaattcatttcattatttttaactttaggaatgtaaaacgctgccattacttgcatagaacagccacttcctataatgaaagatactttgttattgtttattcaaactcagtccttacgaacagccccatatattgtggacaaatgtttcattcttttatctttctgtacttgttcccaatgaactggtgtgctttattatacaccttttaaaggcaaaattaatataacttccatttggcccaaggtaaaaaattttccaatttgatttggattagcatctttcattttccttttatatgttgttaacaaaatagctgcttaccattttcaccttattgacttaaatggacggaggcttttgaatagccctgacatcaaccccagttcgcagcctgtctttctcatttgagagaattcccatctttggctgaattatgaagatgctgctttatacagtgactcaatgggtattcctcagaagtttcttgaagatgtaaaaatgaaattttcttatttttgacccattagcagtcttgtatttacaaggttctaaaacttcactggtcattaacgcttcttttggcaatttgaaaaaaaaaagttacatttaatagactattacacattttcttttgctatgttcaactactaaacttctaattctgttacaaaaggtatcttgaatttttaatgttcctttatgtaaataggataaacttgtacctggacatatctatattattaaccttaagatccctaaataaatgggtttgataaagggttgaatttgggggaatcattaaaattatcaaacctttcgtataaccagatgctcagttttttcagaagtaaatattagatggctttttcatactgtgagatgaggcatttctttttctcctcaagctgatctcagaaacaaatcagtctctcatcagtaaccaagctgtactgtggtaaattatgaagaaggtagatgcgactggtccaatgggcccactgttttgtatattcacacaaggaggcatctttgaaacactatacctatctctttctctaaaaaaaaaaaaaaaaaaaaaaaaaaaacctttccaataaatgttcattctgagtacattaatttttagtgagaaaaagaaacaatcatagagaccccactagagaacctagtgtctgctcagcaaacccatattgagctgtagagcatactttaacagccatctcaaccagctcacccaacgtgtaaattcccttcccatttgggcatagaagttgacagcctagagtgtcaggacggccgagtggtctgaggctccagactcaaggtgagaagctgaaaacctacttgagccaaacaatttggagtgctttatatggttcctttctcaagacccacacaggataaaattttgttgatttactaaagtaatttggatttgaggcagtcttatctctgaaaggatatgcacagcatgtaataaggtgggtgctgttttcataaagagaatcaatctgagaggcatacttttaaaaaaaaaactatcattggagaggttagcaaaggcttaaaagtgaactttgagtctgcaatagtcaatagtattctgattttattggcagtttctgaatgctacaatttcgtgtttttttttaaaaaaatgggctaacagtgcgatgacagtcatgtacaaggagtccaattaaatcatagtaagggtgaagattatttgtgatttatttttatatgagagataaattagtaaggagaaaagatctctttttatgaagtggatatctggctctcaaacccattccttttggctcagacattaaaaaattattaattcccttatggactctcctattccccatgggcggaaaattctgaaaagcagatgagacattctgagccccttgcaagacaaacacagatggtttctaatttagagttttcccacacaaatgcacaaccaatcttggaaatatgacctcaattcccaggattaaaaacgttgaaattatatgttactttccaatataaatagaggatgaagatctttaaagacaactcagaaaatatgatccaataacattcaaatcagagcgtaatctacaatttcacttaatagttaaaagtgaagattagctgcttctttaaaaggggtgagttattaaaggcaacatcctagaaaatgtaataacaagaaggcaacaccatattttcagcaaagttatggtactgataaagcactttgaaaatcctctgtaggaaaatgtcattgagaaacaaaggccaatttgtctccagtgataaagctatctctcattcatatttcataggtggatctatagttttcctggtgtcttggagagaccctacctccacagctcctgcaggagcaaaaccatgttttctgccatgtgagctctctacactggccacagctgattgtaccaaggttcagtacccgacccaaagagactcattttcaggccagagggcggcctaaggaatgaaagtgtacctagcagtggtattcttgtttgatggtacctggccccaccaatcacggccctcttttagggagtttgaacaccagaaagtaaatgatgaataggaagcacagccagaatagacacagtcaccgtaatggtgactctgagaacagtgacagcagttacttctgcagtcaagacaatttgaggtcttgttgattcaccattctgctcttagcttactggagaaatacttgactcctgaacaatgagtctggactttgtagttcctgggttgctttttttttttcttcctttcttatgtattgacataaataaactcacattaactgaa

SEQ ID NO: 165864 - DNA, 2560 bp, Homo sapiens
  Payload ID: 12651
  Gene Symbol: PLD6
  Gene Name: phospholipase D family, member 6
  Uniprot ID: Q8N2A8
  ENST ID: ENST00000321560
  CDS Start-End: 30-788
gtggctgtgggtcccggattagcggcggcatgggacggttgagttggcaggtggcggccgcggcggctgtgggcctggctctgactctggaggcgctgccttgggtgctgcgctggctgcggtccaggcggcggcggccgcggcgcgaggcgctgttcttcccgtctcaggtgacctgtaccgaggccctgctgcgggctccgggcgcggagctggccgagctccccgagggctgcccgtgcggcctgccccacggcgagagcgcgctaagccgcctgctgcgtgccctgctggccgcccgcgccagcctggatctctgcctgttcgccttctccagcccgcagctgggccgcgccgtgcagttgctgcaccagcgtggggtgcgagtgcgggtcgtcaccgactgcgactacatggccctcaacggctcgcaaatcggtctgctgcgcaaggcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttccaggtcgatcccattcccttccctgattctagaaaagtccctcctgctttggctgatgtgggccctttcagcatctccctgagatttcatccctctctccatgtggcacgactggggttggttggggcctacagtctccttgtccctcacagtctgcccctgtcagggctcggtcctcagagtaaggaaaggaaatggaagtcaggaggaagggaagatgtgagtgtgcggtgcgggtggcaaaagcagccttcggggcaaccccgtgagcgtcattgccaccaaaggctggctgttcccttgattccttgcataattgctctttaaaaccagtatgcacgccagtgccaagctcttcagcagcctgtccttgggtagtaagtgctgtggtctgtcaggactgatggccagcagctgtttctatgttgggcttttaactttttttattttatttatttatttatttatcttttttgagatggagtctcactctgtggcccaggctggagtgcagtggcacaacctcggctcactgcatcctctgcctcctgggttcaaacgattgtcctgcctcagcctcccgagtagctgggattacaggtgcctgccacaacacctggctgattttttttttggtatttttagtagagacagggtttcaccatgttggttaggctggtctcaaactcctgacctcaagtgatccaccacttccgcctcccaaagtgctgggattacaggtgtgagccgccatgcccggccgggcttttaacttttaatgtcctaatgttaaggtaattttgttgtgtgtttagaagtgaccttacctttaacacctgtggagttagtgcgtgcacattgctggctcagcgtaacccatcacgggaccggaggagaggagagcggggaagaggagagcagcttcaggccgtggtgtctcccacgtctgtgttcttatttgcagctcagggtttgcattcccaggtagaacaggtgtcgtacactgtgaaatgttccaggttatttgtttataatgtgtgtgtcatatacagatagctccgatgacatctgaagttgtgacttcatcatcttgtcatatttctgtatgatgagccccagggcccatcctgaggtctgctagccatgtgcttagtctcacctccccagcccacgctggcattaccacccagagacccttcagtgctgtgtgtttttcctttttagggttacttttgactcacagtgttaggcaagccagcttggaagttaacttttaaaaaaattcaattgaagctgtaaagtataatatatagattggaagtcaccagaaattgttttagtttgtgaattcccccagtgtatgttctgaaaagaaaatgggagagcttgtaaagcatctcctaaatgcgaagccgcgtgaccctggacttctggcacatctgaataaacatgttcttattctggaa

SEQ ID NO: 165865 - DNA, 2906 bp, Homo sapiens
  Payload ID: 12652
  Gene Symbol: PLD1
  Gene Name: phospholipase D1, phosphatidylcholine-specific
  ENST ID: ENST00000331659
  CDS Start-End: 1888-2346
ccagcccgcagagcacggtcctgggggtgtgatcacagctgctgaccgcggctcccgccgtgtgatgtgaccactcggaggtggggcgagggggccgggggccagcagcagggagtgtgtaaaaggtcttcttcctcacaatacgattgaaggtgtttgggacgtagggctcagatccaggagtgccgtcctccaagccttccataggattttgtgacgcccttgagaaccgcccttgtagactcagtcctgaactaccgccacgcctgtatttgctcctcctcatctcggattattgctttctttacttcctctgtgaagcactaaatactagtagctttttaagaacagaccacaacagtttcttcgtttgaccattactaagtctgcctccaaaatggggagttccgttaactttatcagccagccctgccaattttagttaagataagccttcgtgggcctccaaaggcctctgagagactaggtacccagagacctctgaggtatgttaaatggtttagttcgtggtggtgcaatgaaaacttaaagaaggaaaggaatctgcaatttgaactgttaacagaccccacatttacacactgcctatttgaataagaatctctttcagtattaaatgttttgtgacacacaaatgaatttgtacacagtcttttagcttgaatttgtagacagcctttaaatgttgtttggggatctttggactaattgtataagcgctcagtctggtctcaaactcatgatctcaggttatccatgcgcctcggcctccgaaaatgctgcgattataggcgtgagccaccactcccagccccttcttgtgatgatgtgagatgataaaatgcctgtgtgaagatgaagtgaggcgaataacctaggcagtgtgacataagtggaaaacgccagaaataaacaattcatgttataaattgtgcaccattctgagtagtgtgatgaaatcttgcactcctccattccatcctgccagcattgccagtcactcggtggccatctctgtgatcagattaacagtggttttatcagtatcatagggcttatgttcaagtaactgtattttacttaataatggctacaaagtgcaaaagtagcgatataatatttttggaccatggttgactgcaggtaactgaaattttagttacatgaaaccacagataaggggggactgcactacacataaaataggcataagtaacctcaagacaatagacattattaaaatatagaaaagtaataaagaagtgataaatggagaacttttgctttaatataatttattgtaagtttatataatttaatttttagtaacttcaatttttaatattttaatttttaatgatttatgtgtttaacaactgactcacaaaattgctgaaaatttcccaatcttgatgaaaatttcccagtctgctctcaggagcctatatgagccagcccagaataccactggagttataattttagaagattaccttggtagcaatctgtagaaatgttttgtaggggagctacagtagggatcaaaagtggagacagattacgaaatgtcttcagaccctgccagcatgagggttcaaatgatgtctagtcagtggagatcacgcaaatttcactggtttgtgttcccacgtggatccgtaggaccttcaatgcaagtctccttcaggtattcctggtggtatcttggcattgtctcacatgtgttttgagagccccacttccttggggagtcttccgctttggcttccttgttgatgaccgtgggccaaagggctttgtgtgtgaggctccacctcagccatagctggtgtcctcctgaagaggatttatgccaaaaggagtcacatgccaggacttgtttttttcaagtttgcaaatctggggggagggtggggctctagaaagatgctggaacctggtatgtgccctgcagaaatgtccttgactccttttgtcaccaggagcctaaatttactgtgtttctctgtgactcacagaggcagggggaaagacaatcctctccacttcttcctgcagctacttgctccatcagcctcagccagtctggggctgggcagggaaacaggccctcttccttctcctggtttgtcccctggtttgctcagcgagaccttcgtgtctgagggcccccttctcaccttgcagatcagctggtgtggtactgaatgcctgatggatggccaggggcccctgatccatctgcattcccagaatataagaatctcatttggggccacccagcccccactactcttagtatatgaaataaggtggaatagataagaggatggaactggcccctgggtgcatgatggggccaataacggaggtacagggtgcatatgtggctgggctgtgagacagggaaagaggatggaattgagatgcaaggtagaaaagcatgactatgttcagtttgggacttgatgaaatagatactggtaggacagttcactaggcactgggccttcaggagaaagagaagaaaggaatggtggcattgggagtagtaaagctgtgggtatgaatgagtatctatgagactcacctccctgtgaggacatagaatgaggagacacagtctacaggtagactaggtcgagttcagaagcctgaagaacaccagtgtttaagggatggtgttgggaaagggagccaggccagccagagaggaatgttccggaactctgaaaggaaggaaatggcaggaacaaaggagctggggcacaacagtggtgactcacactgggaacacttcggcccattgtgtttatgcttatagtttcccaagtttatcttttcagggttatgattacgttaacctcacctccctccctccctct

SEQ ID NO: 165866 - DNA, 5604 bp, Homo sapiens
  Payload ID: 12652
  Gene Symbol: PLD1
  Gene Name: phospholipase D1, phosphatidylcholine-specific
  Uniprot ID: Q13393
  ENST ID: ENST00000351298
  CDS Start-End: 128-3352
ccctccctcccgctgagctccagctgtgccagaggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaa

SEQ ID NO: 165867 - DNA, 5855 bp, Homo sapiens
  Payload ID: 12652
  Gene Symbol: PLD1
  Gene Name: phospholipase D1, phosphatidylcholine-specific
  Uniprot ID: Q13393
  ENST ID: ENST00000356327
  CDS Start-End: 72-3182
ccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtctcatataagaagtcttactactgctttctatggcaagttccttttctattgcatcttcccaaagacaagatgctcatctgcaaaggggtgataagatttacttggagggattttatggaaaattcagtgcaataattgcttttttttttttttttgcagtagcagtttacatagtacagcattctgcaaaaattgcatgaaatgtggacacaagatgtactgtatgacttaattacctgtcattctctgacaccattactacctactagaagttcaaataatttatctttaacattgcaatatctgataaactttttaaaatgtaaataattcaaagccttgaaaatctatcatgaatctgctcaacatttcaaagtgactattttgaaatgcctataaatgctatatacctg

SEQ ID NO: 165868 - DNA, 646 bp, Homo sapiens
  Payload ID: 12652
  Gene Symbol: PLD1
  Gene Name: phospholipase D1, phosphatidylcholine-specific
  ENST ID: ENST00000440204
  CDS Start-End: 96-269
aggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaaggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatgtaagttgcaataa

SEQ ID NO: 165869 - DNA, 839 bp, Homo sapiens
  Payload ID: 12652
  Gene Symbol: PLD1
  Gene Name: phospholipase D1, phosphatidylcholine-specific
  ENST ID: ENST00000446289
  CDS Start-End: 1-704
tccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtctaaaatgactccaggtgtcgaagatccctgatctttggcaagaagatgcaaattttaaactaatctgtggtgaagcagagagaatactgggctaggaagctgggctcgtttcagctgtgcgatcctaaataagtccattcaataaagtgttatttagaactttcaa

SEQ ID NO: 165870 - DNA, 621 bp, Homo sapiens
  Payload ID: 12652
  Gene Symbol: PLD1
  Gene Name: phospholipase D1, phosphatidylcholine-specific
  ENST ID: ENST00000418087
  CDS Start-End: 197-621
agccaaaactgggcttgggaacaggaaggctttgcccgtttatttggattctcagggtagtcgattttgccacctcttggctatcagctgccttggagattggtttcatagtaaggattctttctttaaggtgatatggagcaactgctttcacaggggcaccagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcc

SEQ ID NO: 165871 - DNA, 174 bp, Homo sapiens
  Payload ID: 12652
  Gene Symbol: PLD1
  Gene Name: phospholipase D1, phosphatidylcholine-specific
  ENST ID: ENST00000627725
  CDS Start-End: 1-174
atgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaaggtaccaagtattaa

SEQ ID NO: 165872 - DNA, 3503 bp, Homo sapiens
  Payload ID: 12653
  Gene Symbol: PLD2
  Gene Name: phospholipase D2
  Uniprot ID: O14939
  ENST ID: ENST00000263088
  CDS Start-End: 132-2933
cgagggcaggccctgagccccggccccgcctcggccggccccgcctcggccggggcgtgggctccggctgcagctccggtctgctctcttggctccggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaaggttca

SEQ ID NO: 165873 - DNA, 544 bp, Homo sapiens
  Payload ID: 12653
  Gene Symbol: PLD2
  Gene Name: phospholipase D2
  ENST ID: ENST00000575316
  CDS Start-End: 28-544
actgggattgtggatgaaggactaaggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtc

SEQ ID NO: 165874 - DNA, 2278 bp, Homo sapiens
  Payload ID: 12653
  Gene Symbol: PLD2
  Gene Name: phospholipase D2
  ENST ID: ENST00000575246
  CDS Start-End: 45-431
cttggctccggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcggtgagggcgaccggactgcttcctgtagagggcagatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgaggtctgactgggaggaggtgggggagagcatggaaggggtgtcccaggagagagacctggggaatgagtggagtcagtcattgagggctggtggagcagaagcagacgcctggagcctgggaccaaggctggaggccgaggacagggccaggggccaggctgctgatgtctgtctctgattcttgccccagaatcagttcttcattagctgctcagatgggcggacggttctgaacaaggtgggcgatgagattgtggacagaatcctgaaggcccacaa

SEQ ID NO: 165875 - DNA, 3391 bp, Homo sapiens
  Payload ID: 12653
  Gene Symbol: PLD2
  Gene Name: phospholipase D2
  Uniprot ID: O14939
  ENST ID: ENST00000572940
  CDS Start-End: 59-2827
ctccggtctgctctcttggctccggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcagtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaa

SEQ ID NO: 165876 - DNA, 589 bp, Homo sapiens
  Payload ID: 12653
  Gene Symbol: PLD2
  Gene Name: phospholipase D2
  ENST ID: ENST00000576983
  CDS Start-End: 1-589
accaccaaggccaagtacaagactcccacatacccctacctgcttcccaagtctaccagcacggccaatcagctccccttcacacttccaggagggcagtgcaccaccgtacagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccat

SEQ ID NO: 165877 - DNA, 726 bp, Homo sapiens
  Payload ID: 12653
  Gene Symbol: PLD2
  Gene Name: phospholipase D2
  ENST ID: ENST00000576864
  CDS Start-End: 1-592
gcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacgggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaaggttca

SEQ ID NO: 165878 - DNA, 438 bp, Homo sapiens
  Payload ID: 12653
  Gene Symbol: PLD2
  Gene Name: phospholipase D2
  ENST ID: ENST00000575813
  CDS Start-End: 1-146
tgattctcaagtgcagcagctaccggcaggcacggtggtgggcccaagagatcactgagctggcacagggcccaggcagagacttcctacagctgcaccggcatgacagctacgccccaccccggcctgggaccttggcccggtgagctttctggcttctgactcccctgacctccttggcttggcctccccccaggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaaga

SEQ ID NO: 165879 - DNA, 1550 bp, Homo sapiens
  Payload ID: 12654
  Gene Symbol: PLPP1
  Gene Name: phospholipid phosphatase 1
  Uniprot ID: O14494
  ENST ID: ENST00000264775
  CDS Start-End: 341-1198
cctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 165880 - DNA, 1597 bp, Homo sapiens
  Payload ID: 12654
  Gene Symbol: PLPP1
  Gene Name: phospholipid phosphatase 1
  Uniprot ID: O14494
  ENST ID: ENST00000307259
  CDS Start-End: 422-1276
gctgctcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatat

SEQ ID NO: 165881 - DNA, 971 bp, Homo sapiens
  Payload ID: 12654
  Gene Symbol: PLPP1
  Gene Name: phospholipid phosphatase 1
  ENST ID: ENST00000509667
  CDS Start-End: 323-655
gggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggtt

SEQ ID NO: 165882 - DNA, 1228 bp, Homo sapiens
  Payload ID: 12655
  Gene Symbol: PLPP2
  Gene Name: phospholipid phosphatase 2
  Uniprot ID: O43688
  ENST ID: ENST00000269812
  CDS Start-End: 185-883
ggccgggccgggacgcgacgggacgcgctgggaccggcgtcgggggtcgcggggaccatgcagcggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 165883 - DNA, 1397 bp, Homo sapiens
  Payload ID: 12655
  Gene Symbol: PLPP2
  Gene Name: phospholipid phosphatase 2
  Uniprot ID: O43688
  ENST ID: ENST00000327790
  CDS Start-End: 120-1049
ctcgtccctccgaggaccctggaggcggggacctcgcgtgaggaccagacctccctccgcgccccgcactgcgcgcgccctcccaggctcgggggtccccgcgtcccaggcccagggggatgggggtcgcgagaggcccggggagccggggccagcatcccccgccccggcagcaggaagtctgtgcggaggggccgcgcgcgcgcctccatcccgccccgcctggcctgggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaacgg

SEQ ID NO: 165884 - DNA, 1383 bp, Homo sapiens
  Payload ID: 12655
  Gene Symbol: PLPP2
  Gene Name: phospholipid phosphatase 2
  Uniprot ID: O43688
  ENST ID: ENST00000434325
  CDS Start-End: 169-1035
cccctcccctcctcacctctcccctcgtgccctccccgcccctcccctcctccccttcccgcccctcccctcctctccgcgcggggcgggctccgcgccacgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaacgg

SEQ ID NO: 165885 - DNA, 581 bp, Homo sapiens
  Payload ID: 12655
  Gene Symbol: PLPP2
  Gene Name: phospholipid phosphatase 2
  ENST ID: ENST00000591572
  CDS Start-End: 47-581
gacgcgacgggacgcgctgggaccggcgtcgggggtcgcggggaccatgcagcggaggtgggtcttcgtgctgctcgacgtgctgtgcttactggtcggcttttcttccccaccagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttggga

SEQ ID NO: 165886 - DNA, 541 bp, Homo sapiens
  Payload ID: 12655
  Gene Symbol: PLPP2
  Gene Name: phospholipid phosphatase 2
  ENST ID: ENST00000586998
  CDS Start-End: 1-410
ccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtgagcttctaaccctaactctatcccctgtgttgtccagagaccactccccagccaaccctagtgctgccctgggtacccttgccccactgagtccttccttgggcctcctccctgtcagtcctccctgggaccccttcccc

SEQ ID NO: 165887 - DNA, 850 bp, Homo sapiens
  Payload ID: 12655
  Gene Symbol: PLPP2
  Gene Name: phospholipid phosphatase 2
  ENST ID: ENST00000633125
  CDS Start-End: 227-850
tccgcggccgggccgggacgcgacgggacgcgctgggaccggcgtcgggggtcgcggggaccatgcagcggaggtgggtcttcgtgctgctcgacgtgctgtgcttactgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaag

SEQ ID NO: 165888 - DNA, 3292 bp, Homo sapiens
  Payload ID: 12656
  Gene Symbol: PLPP3
  Gene Name: phospholipid phosphatase 3
  Uniprot ID: O14495
  ENST ID: ENST00000371250
  CDS Start-End: 553-1488
agtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagtttccctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaa

SEQ ID NO: 165889 - DNA, 1135 bp, Homo sapiens
  Payload ID: 12657
  Gene Symbol: PLPP4
  Gene Name: phospholipid phosphatase 4
  ENST ID: ENST00000369073
  CDS Start-End: 1-786
atgcatggaattggtccttctggcagttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagac

SEQ ID NO: 165890 - DNA, 1521 bp, Homo sapiens
  Payload ID: 12657
  Gene Symbol: PLPP4
  Gene Name: phospholipid phosphatase 4
  Uniprot ID: Q5VZY2
  ENST ID: ENST00000398250
  CDS Start-End: 353-1168
cgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttgg

SEQ ID NO: 165891 - DNA, 885 bp, Homo sapiens
  Payload ID: 12657
  Gene Symbol: PLPP4
  Gene Name: phospholipid phosphatase 4
  ENST ID: ENST00000427079
  CDS Start-End: 85-885
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcacc

SEQ ID NO: 165892 - DNA, 853 bp, Homo sapiens
  Payload ID: 12658
  Gene Symbol: PLPP5
  Gene Name: phospholipid phosphatase 5
  Uniprot ID: Q8NEB5
  ENST ID: ENST00000422581
  CDS Start-End: 9-659
gcggccggatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataaaaagattttatttagaaa

SEQ ID NO: 165893 - DNA, 2130 bp, Homo sapiens
  Payload ID: 12658
  Gene Symbol: PLPP5
  Gene Name: phospholipid phosphatase 5
  Uniprot ID: Q8NEB5
  ENST ID: ENST00000424479
  CDS Start-End: 22-816
tcgctcggagctcgcggccggatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaataaaa

SEQ ID NO: 165894 - DNA, 794 bp, Homo sapiens
  Payload ID: 12658
  Gene Symbol: PLPP5
  Gene Name: phospholipid phosphatase 5
  Uniprot ID: Q8NEB5
  ENST ID: ENST00000419686
  CDS Start-End: 45-575
gaggtggccacgtcagcgcagcgtcgctcggagctcgcggccggatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaaga

SEQ ID NO: 165895 - DNA, 745 bp, Homo sapiens
  Payload ID: 12658
  Gene Symbol: PLPP5
  Gene Name: phospholipid phosphatase 5
  ENST ID: ENST00000534339
  CDS Start-End: 1-734
cggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatct

SEQ ID NO: 165896 - DNA, 831 bp, Homo sapiens
  Payload ID: 12658
  Gene Symbol: PLPP5
  Gene Name: phospholipid phosphatase 5
  ENST ID: ENST00000524616
  CDS Start-End: 1-738
gggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcc

SEQ ID NO: 165897 - DNA, 581 bp, Homo sapiens
  Payload ID: 12658
  Gene Symbol: PLPP5
  Gene Name: phospholipid phosphatase 5
  ENST ID: ENST00000531109
  CDS Start-End: 1-183
gcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattat

SEQ ID NO: 165898 - DNA, 2185 bp, Homo sapiens
  Payload ID: 12658
  Gene Symbol: PLPP5
  Gene Name: phospholipid phosphatase 5
  Uniprot ID: Q8NEB5
  ENST ID: ENST00000529359
  CDS Start-End: 200-871
gttcgcggccttcctgtaagaaagatccacggccgggcccgggcggccccgcttcccaggcaggcgggcggcacggggcggcgggtcgggcagtggggaagcggggaggaagccaggcgacctgctctgcgcttctttgttcccctctagggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaataaaa

SEQ ID NO: 165899 - DNA, 875 bp, Homo sapiens
  Payload ID: 12658
  Gene Symbol: PLPP5
  Gene Name: phospholipid phosphatase 5
  ENST ID: ENST00000531823
  CDS Start-End: 431-829
cctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgtgcgtggagaaagatcgtctttcctccctccccatgacccggcttcccgcgggcacctgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaac

SEQ ID NO: 165900 - DNA, 2944 bp, Homo sapiens
  Payload ID: 12659
  Gene Symbol: PLPP6
  Gene Name: phospholipid phosphatase 6
  Uniprot ID: Q8IY26
  ENST ID: ENST00000381883
  CDS Start-End: 62-949
gcagggccgggaagcctctgtttggtccggccaggtcccgggatccgggccgccagctgcgatgccaagtccccggaggagcatggagggacggccgctgggcgtctccgcttcgagcagcagcagcagccccggcagcccagcccatggcggcggtggcggcggcagcaggtttgagttccagtccctgctcagcagccgcgccacggccgtggaccccacctgcgcccggctccgtgcatcggagagcccagttcaccgccgcggctccttccccctggccgcggcgggcccctcgcagtcgcccgcgcctccgctgcccgaggaggaccgcatggacttgaacccgtccttcctgggcatcgccctgcgctccctgctggccatcgacctgtggctgtccaagaagctgggggtgtgcgcgggagagagctcgtcgtggggcagcgtgcgaccccttatgaagctgctggagatctcgggacacggcatcccctggctgctgggcaccctctactgcctgtgcaggagcgacagctgggccgggcgcgaggtgctgatgaacctgctcttcgccctgctgttggacctgctgctggtggccttgatcaaagggctggtccgcaggcgccgcccggcccacaaccagatggacatgtttgtcactctctcggtggacaagtactccttcccctcgggccatgccacaagggccgccctgatgtcgaggttcatcctgaaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccaaaaaatcctctattgtatatttattcaacaactgtttatgtttccaggacaactgcaaagaaaacaagctgaggtggttatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaacggctgtgataagtaggttttgattgagtgaaagcatgagcttgttcagagtgaggggcatagtgaaaaaggaacagccatgcctcaaaatcaaatcatttgcattcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtgaa

SEQ ID NO: 165901 - DNA, 972 bp, Homo sapiens
  Payload ID: 12660
  Gene Symbol: PLPP7
  Gene Name: phospholipid phosphatase 7 (inactive)
  ENST ID: ENST00000372261
  CDS Start-End: 187-642
ccccttggagctgggtggcagaggagataaacagccatgtgcaactctccacactatatttaacagctgcggcggagaaggcagggaggcagccacggtggcggctctgggggcagctcttgtcttcggggagaaggcccttggagccgggctggcatcggccttctcggggtgagcgaggtcaccatgccagcttcccagagccgggcccgtgcccgggaccgcaacaacgtcctcaaccgggctgagttcctgtccctgaaccagccccccaaggggggcccggagccccgcagctcgggcagaaaggcctcgggcccatcagcacagcccccacctgctggtgacggggccagagagcgacgccagtcacagcagctgccagaggaggactgcatgcagctgaacccctccttcaagggcatcgccttcaactccctgctggccatcgatatctgtatgtccaagcggctgggggtgtgcgctggccgggcggcgtcctgggccagtgcccgctccatggtcaagctcatcggcatcacgggccacggcatcccctggatcggaggcaccatcctctgcctggtgaagagcagcacactggccggccaggaggtgctcatgaatctgctcctggattagcaccgccctgtgccaggtgccacgtggggcccatgtggaggcaagccattccctccacccagaggtgatgcccagcccccgtccggcccacccttcgggcaccaccaggtccccaaggtgccccaggaagcttccaccctccacgccaggcccgcatcgatttccttgtctttcccggtgtggccatcatttgagggacatgtgaggtggaggtctcaggcaaggcaaacattaacaaggggtctcagttccaaaagggcattgggttggaccacggagaacatcagttccagaggaagttacaataaaaacacgtatctccctgctcta

SEQ ID NO: 165902 - DNA, 2095 bp, Homo sapiens
  Payload ID: 12660
  Gene Symbol: PLPP7
  Gene Name: phospholipid phosphatase 7 (inactive)
  Uniprot ID: Q8NBV4
  ENST ID: ENST00000372264
  CDS Start-End: 305-1120
aaatagcccaggcccgaggcagccaggccgcagctgtggactcctcacctcccggaggctctgctggtgcaggccccgcattggagggctcgattggctgcccggctggcactgacgtccccttggagctgggtggcagaggagataaacagccatgtgcaactctccacactatatttaacagctgcggcggagaaggcagggaggcagccacggtggcggctctgggggcagctcttgtcttcggggagaaggcccttggagccgggctggcatcggccttctcggggtgagcgaggtcaccatgccagcttcccagagccgggcccgtgcccgggaccgcaacaacgtcctcaaccgggctgagttcctgtccctgaaccagccccccaaggggggcccggagccccgcagctcgggcagaaaggcctcgggcccatcagcacagcccccacctgctggtgacggggccagagagcgacgccagtcacagcagctgccagaggaggactgcatgcagctgaacccctccttcaagggcatcgccttcaactccctgctggccatcgatatctgtatgtccaagcggctgggggtgtgcgctggccgggcggcgtcctgggccagtgcccgctccatggtcaagctcatcggcatcacgggccacggcatcccctggatcggaggcaccatcctctgcctggtgaagagcagcacactggccggccaggaggtgctcatgaatctgctcctggccctgctcctggacatcatgacggtggccggcgtgcagaagctcatcaagcggcgcggcccgtacgagacgagccccagcctcctggactacctcaccatggacatctacgccttcccggccgggcacgccagccgcgccgccatggtgtccaagttcttcctcagccacctggtgctggcggtgcccctgcgtgtgctgctggtgctctgggccctctgcgtgggcctgtcccgcgtgatgatcggccgccaccacgtcacggacgtcctctccggctttgtcatcggctacctccagttccgtctggtggagctggtctggatgccctccagcacctgccagatgctcatctctgcctggtgaagcgcccgccggcccacacaagcctctgggggcagggctggccctagagaaggggcagggggtggcgaggtggcgggcgtgggtggaacagagcggccaggagtcagagcggccacccccacctcatcttcccctcctggctggaggctggcgaacccaggccacccctcccggagacaagcgtgtttggcagtgccaggcctcttgcccctttgcttggactccaagtctcctctctaggcagccaggacccacccatggggacagccctatttagcttctgctctgggaacagcaaaaatcaggatggtgggaggggccgagtcttgtcttgtcctttcatcatcatgactgttgagttcttggctgtgcccatcacgccacagcacgacgcctgccaaaatgcccccaacctactgcctgatgcaggtgccattgccattagcggtcatcgacagcttagggcagcactttccaacgggtgcccatgggacaccagcctgcgagatgcttttgggggaaaggggttttgtggttcaataactttcggaagtgctgcacactctgtccccaagttggacattcacaaaggccgttattgccgtaaaggctctgacaagccctatagaaaagcttcttgctaaaccttctttaacccatgttttctaaacttatttgaccacagaacccttttcttggggaacagctattaacccccaaggaattattggttcctcaagtgcgttttgggagctgctgccagagagctaaagggcctggggtgtgagctgactctcctctggggaggccgggtgcacacgccacagcccgaggaaagtgctggccaccgcccgtgggcatcgatgaggctttggcccccaggggccggactccgtgtgacctaataggtcgtttccaagtcacccgttttggatgtgcatttcatgtgacaatacagatgacatgcaaatggcc

SEQ ID NO: 165903 - DNA, 2495 bp, Homo sapiens
  Payload ID: 12661
  Gene Symbol: PLPPR1
  Gene Name: phospholipid phosphatase related 1
  Uniprot ID: Q8TBJ4
  ENST ID: ENST00000374874
  CDS Start-End: 440-1417
ctccgccccctccgcgccagccttttgctctttcctttcattaaacaaacaggagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgta

SEQ ID NO: 165904 - DNA, 2318 bp, Homo sapiens
  Payload ID: 12661
  Gene Symbol: PLPPR1
  Gene Name: phospholipid phosphatase related 1
  Uniprot ID: Q8TBJ4
  ENST ID: ENST00000395056
  CDS Start-End: 267-1244
aattctctaggttgcaaattgggaggattaggaacaagtaagagagatccatgcaggatggacaagaaaaaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaa

SEQ ID NO: 165905 - DNA, 472 bp, Homo sapiens
  Payload ID: 12661
  Gene Symbol: PLPPR1
  Gene Name: phospholipid phosphatase related 1
  ENST ID: ENST00000456287
  CDS Start-End: 164-472
cagaaagtgagccagatggagctggaatgtagaggactcgtcgtgagcggggagcccacttggtcagctcagtgaaggctctccctcagacgccaacatctacatgcggatatggaagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgatt

SEQ ID NO: 165906 - DNA, 2318 bp, Homo sapiens; identical to SEQ ID NO: 165904
  Payload ID: 12661
  Gene Symbol: PLPPR1
  Gene Name: phospholipid phosphatase related 1
  Uniprot ID: Q8TBJ4
  ENST ID: ENST00000614834
  CDS Start-End: 267-1244

SEQ ID NO: 165907 - DNA, 2495 bp, Homo sapiens; identical to SEQ ID NO: 165903
  Payload ID: 12661
  Gene Symbol: PLPPR1
  Gene Name: phospholipid phosphatase related 1
  Uniprot ID: Q8TBJ4
  ENST ID: ENST00000611695
  CDS Start-End: 440-1417

SEQ ID NO: 165908 - DNA, 472 bp, Homo sapiens; identical to SEQ ID NO: 165905
  Payload ID: 12661
  Gene Symbol: PLPPR1
  Gene Name: phospholipid phosphatase related 1
  ENST ID: ENST00000633861
  CDS Start-End: 164-472

SEQ ID NO: 165909 - DNA, 748 bp, Homo sapiens
  Payload ID: 12661
  Gene Symbol: PLPPR1
  Gene Name: phospholipid phosphatase related 1
  ENST ID: ENST00000632580
  CDS Start-End: 64-748
ggagggagtgtgctctgaggggcaagggctgctccgaagccctgctaatgtctctgtgtggccatgctgtattttcagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctca

SEQ ID NO: 165910 - DNA, 2727 bp, Homo sapiens
  Payload ID: 12662
  Gene Symbol: PLPPR2
  Gene Name: phospholipid phosphatase related 2
  Uniprot ID: Q96GM1
  ENST ID: ENST00000251473
  CDS Start-End: 377-1408
atgcaaatgagacgcccggaggccccgcccctccctccacctcggagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaa

SEQ ID NO: 165911 - DNA, 535 bp, Homo sapiens
  Payload ID: 12662
  Gene Symbol: PLPPR2
  Gene Name: phospholipid phosphatase related 2
  ENST ID: ENST00000586380
  CDS Start-End: 338-535
tctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcacaccccctgggactcccactccctccccacctctgcaggcctggccttcaccatggcgggagggagaccgcatctgaagaggagtttctccatcatcccctgctttgtcttcgtggagggattcttctgctatgacagtacctacgccaagccctacccagggcctgaggctgccagccgagtgcctcctgctcttgtctacgcactggtcactgccgggcccaccctcacgatcctgctgggagagctg

SEQ ID NO: 165912 - DNA, 2552 bp, Homo sapiens
  Payload ID: 12662
  Gene Symbol: PLPPR2
  Gene Name: phospholipid phosphatase related 2
  ENST ID: ENST00000591608
  CDS Start-End: 265-1548
agtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagttaagtgtggcgcaggaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaac

SEQ ID NO: 165913 - DNA, 633 bp, Homo sapiens
  Payload ID: 12662
  Gene Symbol: PLPPR2
  Gene Name: phospholipid phosphatase related 2
  ENST ID: ENST00000591329
  CDS Start-End: 380-633
acctcggagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcacaccccctgggactcccactccctccccacctctgcaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcac

SEQ ID NO: 165914 - DNA, 2387 bp, Homo sapiens
  Payload ID: 12663
  Gene Symbol: PLPPR3
  Gene Name: phospholipid phosphatase related 3
  ENST ID: ENST00000359894
  CDS Start-End: 65-2305
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcggtgagtccggcccctcactgcccttcccaggccctcttgctgacccgtggggagccctccctgaccccaacccccatgccccagatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccga

SEQ ID NO: 165915 - DNA, 2328 bp, Homo sapiens
  Payload ID: 12663
  Gene Symbol: PLPPR3
  Gene Name: phospholipid phosphatase related 3
  Uniprot ID: Q6T4P5
  ENST ID: ENST00000520876
  CDS Start-End: 90-2246
tcccggctcccggccccgccccacggaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcgatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgcgcggatgctcaataaagcggcagaaaccga

SEQ ID NO: 165916 - DNA, 362 bp, Homo sapiens
  Payload ID: 12663
  Gene Symbol: PLPPR3
  Gene Name: phospholipid phosphatase related 3
  ENST ID: ENST00000517665
  CDS Start-End: 1-362
gacatccacgccatcctgtctgcacggaagaccttcccgtcccagcacgccacgctgtcagccttcgccgcggtctatgtgtcgctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccga

SEQ ID NO: 165917 - DNA, 782 bp, Homo sapiens
  Payload ID: 12663
  Gene Symbol: PLPPR3
  Gene Name: phospholipid phosphatase related 3
  ENST ID: ENST00000519502
  CDS Start-End: 397-782
acggaggagacgcgctttgtgctgggcgccggccgcgccaggtgaggggctgtggggctgggggcgcggacccagtctcctccgccgcccggaaccccagttctcccggatgccccccaccaccacgcggggactggctcccgcccggagaccccccgccctcctcggcgatcccggccccgaccccccgatcccgggtgtaggggcgcccggaagccgcgtgctgggccggggcgcggggaggccacgcggacgccgctctctgcagcctcagtttccccgaccgcccctcccccgccggcgccggccaccgtgtctcccccgggctccgcctgcgcgcccccctccagcgccgctttctcccctccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcg

SEQ ID NO: 165918 - DNA, 164 bp, Homo sapiens
  Payload ID: 12663
  Gene Symbol: PLPPR3
  Gene Name: phospholipid phosphatase related 3
  ENST ID: ENST00000633654
  CDS Start-End: 90-164
tcccggctcccggccccgccccacggaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggag

SEQ ID NO: 165919 - DNA, 139 bp, Homo sapiens
  Payload ID: 12663
  Gene Symbol: PLPPR3
  Gene Name: phospholipid phosphatase related 3
  ENST ID: ENST00000632433
  CDS Start-End: 65-139
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggag

SEQ ID NO: 165920 - DNA, 471 bp, Homo sapiens
  Payload ID: 12663
  Gene Symbol: PLPPR3
  Gene Name: phospholipid phosphatase related 3
  ENST ID: ENST00000633312
  CDS Start-End: 397-471
acggaggagacgcgctttgtgctgggcgccggccgcgccaggtgaggggctgtggggctgggggcgcggacccagtctcctccgccgcccggaaccccagttctcccggatgccccccaccaccacgcggggactggctcccgcccggagaccccccgccctcctcggcgatcccggccccgaccccccgatcccgggtgtaggggcgcccggaagccgcgtgctgggccggggcgcggggaggccacgcggacgccgctctctgcagcctcagtttccccgaccgcccctcccccgccggcgccggccaccgtgtctcccccgggctccgcctgcgcgcccccctccagcgccgctttctcccctccagccacggcctgcggcgcccgcggcaccatgatctccaccaaggagaagaacaagatcccgaaggacagcatgacgcttctgccctgcttctacttcgtggag

SEQ ID NO: 165921 - DNA, 4505 bp, Homo sapiens
  Payload ID: 12664
  Gene Symbol: PLPPR4
  Gene Name: phospholipid phosphatase related 4
  ENST ID: ENST00000370184
  CDS Start-End: 108-1925
cttaagtatctgtttagaagtttaggaattttctatactgtcttcttgaaatcaacttagagaaaatgaacacaatagattttaagatcttaattcactaatgtttaatgaatatgtttgatgctgacacaaccaccaacttggtaacaatttctttcattttgcctataggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaa

SEQ ID NO: 165922 - DNA, 5369 bp, Homo sapiens
  Payload ID: 12664
  Gene Symbol: PLPPR4
  Gene Name: phospholipid phosphatase related 4
  Uniprot ID: Q7Z2D5
  ENST ID: ENST00000370185
  CDS Start-End: 498-2789
gagctgtcattcctgggtagcaacaagctgtcagttaatgcctacctcagcctacttttcagtatgggatccaagatctcatttcgtggaggtaggggttggttttcttgctatgggtcagcgcgctggagcagggcttctgatccttagcattctttaatagcattcctagagtgacctaggaggctccccaggaggagactaggtggcttagctcctcagcctaactactgcagaaaccaggagtgcgtcctccttttcggattcttgacgtcaagctccgacagccttggagcgtcgcaagggcggtagagagctgagggagggtgacagggaggggaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaa

SEQ ID NO: 165923 - DNA, 4846 bp, Homo sapiens
  Payload ID: 12664
  Gene Symbol: PLPPR4
  Gene Name: phospholipid phosphatase related 4
  ENST ID: ENST00000457765
  CDS Start-End: 159-2276
gaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatc

SEQ ID NO: 165924 - DNA, 3288 bp, Homo sapiens
  Payload ID: 12665
  Gene Symbol: PLPPR5
  Gene Name: phospholipid phosphatase related 5
  Uniprot ID: Q32ZL2
  ENST ID: ENST00000263177
  CDS Start-End: 223-1188
ggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaatctttctaaactttacagtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagca

SEQ ID NO: 165925 - DNA, 4139 bp, Homo sapiens
  Payload ID: 12665
  Gene Symbol: PLPPR5
  Gene Name: phospholipid phosphatase related 5
  ENST ID: ENST00000370188
  CDS Start-End: 362-1312
ccagcgccgctgcttctcgaatggtctcgtgcaggggcgcagcggccgctgcccgtcgcccgggactccccgccctccctcgcgaccccgcgccggggcgggcggcgcttgcggcgggcagggggcgggcaggggagagggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaatctttctaaactttacagtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagcaggaatgtttttcctgttggaagccttagccatatattcttatgtcaaggttgcttctttgcaccttgctaaacctgatacgaatgcaggagttttaaattcttcaaaaactcagatttaacccagaaccagagtaaagtcacctctactatttacacatcataggctcaagattgtacagtgagtgatgctgtcatgaagaaaattcagatgaaaaaggcaagatacatgtgaataaggcaaaagccagaaaatagcccttattcatgatgctgttactgagaataatgaaaatcatatttcagaaaatattaccatgtaaatatgtacatatgtagtctagtaaaagcaggcaaacacatatctttctgataaaaacatctcctttttattctacttacttggggcccaggtcagtataatttagtcaacttgaaaatttcggtagtctctgtttgcatggcagaaattctgcacatgttttatctgattcctgtgataacttaaaaggctcttttatgttaaaagagaggtgaatcttctttgacagactttgtattttccacttctaactgggcctctcttttctcaggatctatcctagccaaatatctcagttacatttaccatacagtttcctttgtgaaagaacagtaggggaggaaataattctctgctgtgtattgtatttttcaaataaaaatttaaaaattcaattgaaaactgaa

SEQ ID NO: 165926 - DNA, 2233 bp, Homo sapiens
  Payload ID: 12666
  Gene Symbol: PLSCR1
  Gene Name: phospholipid scramblase 1
  Uniprot ID: O15162
  ENST ID: ENST00000342435
  CDS Start-End: 412-1368
gagtcccagttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgta

SEQ ID NO: 165927 - DNA, 996 bp, Homo sapiens
  Payload ID: 12666
  Gene Symbol: PLSCR1
  Gene Name: phospholipid scramblase 1
  Uniprot ID: O15162
  ENST ID: ENST00000448787
  CDS Start-End: 193-906
aaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaagg

SEQ ID NO: 165928 - DNA, 983 bp, Homo sapiens
  Payload ID: 12666
  Gene Symbol: PLSCR1
  Gene Name: phospholipid scramblase 1
  ENST ID: ENST00000468985
  CDS Start-End: 152-277
agtctagaggcgcagaagaggaagccatcgcctggccccggctctctggaccttgtctcgctcgggagcggaaacagcggcagccagaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcct

SEQ ID NO: 165929 - DNA, 870 bp, Homo sapiens
  Payload ID: 12666
  Gene Symbol: PLSCR1
  Gene Name: phospholipid scramblase 1
  ENST ID: ENST00000478267
  CDS Start-End: 86-211
gaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgtaagtctgttcttattaatcttgattatagatgctttctctaggttcattctgaaatgattcagtaaagtgtatatttcaaaatgacattttaaaatttata

SEQ ID NO: 165930 - DNA, 984 bp, Homo sapiens
  Payload ID: 12666
  Gene Symbol: PLSCR1
  Gene Name: phospholipid scramblase 1
  ENST ID: ENST00000489775
  CDS Start-End: 144-269
ggcgcagaagaggaagccatcgcctggccccggctctctggaccttgtctcgctcgggagcggaaacagcggcagccagaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagcca

SEQ ID NO: 165931 - DNA, 1443 bp, Homo sapiens
  Payload ID: 12666
  Gene Symbol: PLSCR1
  Gene Name: phospholipid scramblase 1
  ENST ID: ENST00000487389
  CDS Start-End: 280-1215
cttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttatt

SEQ ID NO: 165932 - DNA, 862 bp, Homo sapiens
  Payload ID: 12666
  Gene Symbol: PLSCR1
  Gene Name: phospholipid scramblase 1
  ENST ID: ENST00000462666
  CDS Start-End: 118-862
gcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacag

SEQ ID NO: 165933 - DNA, 701 bp, Homo sapiens
  Payload ID: 12666
  Gene Symbol: PLSCR1
  Gene Name: phospholipid scramblase 1
  ENST ID: ENST00000486631
  CDS Start-End: 188-701
aggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaac

SEQ ID NO: 165934 - DNA, 581 bp, Homo sapiens
  Payload ID: 12666
  Gene Symbol: PLSCR1
  Gene Name: phospholipid scramblase 1
  ENST ID: ENST00000488253
  CDS Start-End: 78-203
catcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaat

SEQ ID NO: 165935 - DNA, 701 bp, Homo sapiens
  Payload ID: 12666
  Gene Symbol: PLSCR1
  Gene Name: phospholipid scramblase 1
  ENST ID: ENST00000463777
  CDS Start-End: 103-228
agtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttccttt

SEQ ID NO: 165936 - DNA, 1384 bp, Homo sapiens
  Payload ID: 12666
  Gene Symbol: PLSCR1
  Gene Name: phospholipid scramblase 1
  ENST ID: ENST00000493432
  CDS Start-End: 165-290
gccccggctctctggaccttgtctcgctcgggagcggaaacagcggcagccagagcataaaatacacaagaggatttttatggaatggctccttgttacaaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 165937 - DNA, 514 bp, Homo sapiens
  Payload ID: 12666
  Gene Symbol: PLSCR1
  Gene Name: phospholipid scramblase 1
  ENST ID: ENST00000483300
  CDS Start-End: 1-514
ctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttt

SEQ ID NO: 165938 - DNA, 1198 bp, Homo sapiens
  Payload ID: 12666
  Gene Symbol: PLSCR1
  Gene Name: phospholipid scramblase 1
  ENST ID: ENST00000472349
  CDS Start-End: 451-1198
gttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagcataaaatacacaagaggatttttatggaatggctccttgttacaagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctc

SEQ ID NO: 165939 - DNA, 1272 bp, Homo sapiens
  Payload ID: 12667
  Gene Symbol: PLSCR2
  Gene Name: phospholipid scramblase 2
  Uniprot ID: Q9NRY7
  ENST ID: ENST00000336685
  CDS Start-End: 334-1008
ggccgaatggagaatgaagccttttcaaattcacctcccagtgaaccaccctcaaaatagaagtgaatgtgaaaccacagatatttcattaaaacatatctgaagataaaaacatacctcaagcttcacagatataggacttctgagctgagaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgcaaggaagatgtaaggaaaaactcgcacactatctgtggaactcatttaaattcaaatactagataaacatttcgcattgaatatttacatggagaaaaatcatcaaacatcaacaattatcaagttaattaataaaaatactaggtattgcaaaaaag

SEQ ID NO: 165940 - DNA, 759 bp, Homo sapiens
  Payload ID: 12667
  Gene Symbol: PLSCR2
  Gene Name: phospholipid scramblase 2
  ENST ID: ENST00000489015
  CDS Start-End: 277-759
gtatctgcccatcttagattcttcctagcaataattctgagagactctggattgtgggccgaatggagaatgaagccttttcaaattcacctcccaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgag

SEQ ID NO: 165941 - DNA, 574 bp, Homo sapiens
  Payload ID: 12667
  Gene Symbol: PLSCR2
  Gene Name: phospholipid scramblase 2
  ENST ID: ENST00000463633
  CDS Start-End: 171-287
gacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttattgactctggatgaggaaatggttattggaaagatttcaaaacagtactctggatttgtaaggggaatattaaccaatggtgagaaatttgggatccagtttccatttgatcttgatgttaaaattaaagcattgatgcttggagcaactttcctcattgaatacatgtattttgaactgtggccataagaattaccctgaaagaatatgtcagagattactggcatttatttttgccagccctcaacaaaactaagcaactttcactgaaaatatctaaataaagttttattttactaaa

SEQ ID NO: 165942 - DNA, 1441 bp, Homo sapiens
  Payload ID: 12667
  Gene Symbol: PLSCR2
  Gene Name: phospholipid scramblase 2
  Uniprot ID: Q9NRY7
  ENST ID: ENST00000497985
  CDS Start-End: 441-1334
acaccagaaccgttcgaatgacaaggggtgtcctgcctgaaaacgccttgcggggctcagcttccccttagctacactgctttacaggtagagagcggccctgaatcctgggcagagtctgggctcaggagcatgtgccagcatagtggggctattagaagggacggttaatacagcctgcaagctgtcatttatcaggccaaataaacccacttggaattattcaacctttgctgaacttcttgagtagatgtaactaagaggtgactataattggagaattcttaagagtttcactatattatgaaaatgtgtgcttaaagttggtaatcataaaaaataattttgaaatggcagcttatgaaaggatattatttgtagctgtgttttcccttgtaaattccagtactgggcactcctgaaaacttcgcaagatatatatgagatcatggaactcactcttctgcttaaattcctccagacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgca

SEQ ID NO: 165943 - DNA, 1001 bp, Homo sapiens
  Payload ID: 12667
  Gene Symbol: PLSCR2
  Gene Name: phospholipid scramblase 2
  Uniprot ID: Q9NRY7
  ENST ID: ENST00000610787
  CDS Start-End: 299-973
tcacagtgaaccaccctcaaaatagaagtgaatgtgaaaccacagatatttcattaaaacatatctgaagataaaaacatacctcaagcttcacagatataggacttctgagctgagaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtgg

SEQ ID NO: 165944 - DNA, 1208 bp, Homo sapiens
  Payload ID: 12667
  Gene Symbol: PLSCR2
  Gene Name: phospholipid scramblase 2
  Uniprot ID: Q9NRY7
  ENST ID: ENST00000613069
  CDS Start-End: 70-951
gtatctgcccatcttagattcttcctagcaataattctgagagactctggattgtgggccgaatggagaatgaagccttttcaaattcacctcccaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgcaaggaagatgtaaggaaaaactcgcacactatctgtggaactcatttaaattcaaatactagataaacatttcgcattgaatatttacatggagaaaaatcatcaaacatcaacaattatcaagttaattaataaaaatactaggtattgc

SEQ ID NO: 165945 - DNA, 3303 bp, Homo sapiens
  Payload ID: 12668
  Gene Symbol: PLSCR4
  Gene Name: phospholipid scramblase 4
  Uniprot ID: Q9NRQ2
  ENST ID: ENST00000354952
  CDS Start-End: 242-1231
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 165946 - DNA, 3033 bp, Homo sapiens
  Payload ID: 12668
  Gene Symbol: PLSCR4
  Gene Name: phospholipid scramblase 4
  ENST ID: ENST00000383083
  CDS Start-End: 242-961
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 165947 - DNA, 1442 bp, Homo sapiens
  Payload ID: 12668
  Gene Symbol: PLSCR4
  Gene Name: phospholipid scramblase 4
  Uniprot ID: Q9NRQ2
  ENST ID: ENST00000446574
  CDS Start-End: 333-1322
ggccgcggtgcctgcgggcaggcgcggaggttgcgcggcgtcctgcgctagcagttcccggacactgcgctcgcgtcgcatcctcaggtggttgcagaagttccgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttatt

SEQ ID NO: 165948 - DNA, 2839 bp, Homo sapiens
  Payload ID: 12668
  Gene Symbol: PLSCR4
  Gene Name: phospholipid scramblase 4
  Uniprot ID: Q9NRQ2
  ENST ID: ENST00000433593
  CDS Start-End: 159-833
ataacttgaaaaatcctctccgtctcccttccctgcctcctttcctttccctttcctctgccagtacaactagacccggcgtctggcgtccccggtgcccagcattctgcggggcaggcggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctgg

SEQ ID NO: 165949 - DNA, 593 bp, Homo sapiens
  Payload ID: 12668
  Gene Symbol: PLSCR4
  Gene Name: phospholipid scramblase 4
  ENST ID: ENST00000498625
  CDS Start-End: 301-593
aacatttcttgactttttttaaatctcattctactacaatataaactgcagcacagtaggtggcagagtgtctgtctgcttcattgctgtactctcaacatctgtattagtgcctcgtacataataggtgctcaataagtatttttttaattaatgaagggacaaatgtaaggtaactggaggttaaaaaaattacagaaatccttacctgtgttactgagtagcaatactatttattatgtatgtattttaaaggcattaacattttttatttttcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataac

SEQ ID NO: 165950 - DNA, 1054 bp, Homo sapiens
  Payload ID: 12668
  Gene Symbol: PLSCR4
  Gene Name: phospholipid scramblase 4
  ENST ID: ENST00000460350
  CDS Start-End: 269-1054
cccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgag

SEQ ID NO: 165951 - DNA, 814 bp, Homo sapiens
  Payload ID: 12668
  Gene Symbol: PLSCR4
  Gene Name: phospholipid scramblase 4
  ENST ID: ENST00000476202
  CDS Start-End: 191-814
gtttataacttgaaaaatcctctccgtctcccttccctgcctcctttcctttccctttcctctgccagtacaactagacccggcgtctggcgtccccggtgcccagcattctgcggggcaggcgcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagag

SEQ ID NO: 165952 - DNA, 683 bp, Homo sapiens
  Payload ID: 12668
  Gene Symbol: PLSCR4
  Gene Name: phospholipid scramblase 4
  ENST ID: ENST00000481701
  CDS Start-End: 256-683
gtgtttctcttaagcttgttacattgttttcctcataactgtactatctaacgttaaactttaacatttcttgactttttttaaatctcattctactacaatataaactgcagcacagtaggtggcagagtgtctgtctgcttcattgctgtactctcaacatctgtattagtgcctcgtacataataggtgctcaataagtatttttttaattaatgaagggacaaatgtaaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagata

SEQ ID NO: 165953 - DNA, 1375 bp, Homo sapiens
  Payload ID: 12668
  Gene Symbol: PLSCR4
  Gene Name: phospholipid scramblase 4
  Uniprot ID: Q9NRQ2
  ENST ID: ENST00000493382
  CDS Start-End: 332-1321
aggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcagcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttgga

SEQ ID NO: 165954 - DNA, 609 bp, Homo sapiens
  Payload ID: 12668
  Gene Symbol: PLSCR4
  Gene Name: phospholipid scramblase 4
  ENST ID: ENST00000460885
  CDS Start-End: 168-609
ctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatg

SEQ ID NO: 165955 - DNA, 1969 bp, Homo sapiens
  Payload ID: 12669
  Gene Symbol: PLSCR5
  Gene Name: phospholipid scramblase family, member 5
  Uniprot ID: A0PG75
  ENST ID: ENST00000443512
  CDS Start-End: 1005-1820
ctttgtcaaataaggaaaactcaaacttttggcagtctgcaaactgtgaggttgactttataatttttcatcacaaggtatacctcctgaagcctcttaactattttcagaaaaagacagtgttgctgataatgcaatatatcctgcatgttcaacctttgtgaatcataccatgtagggcaattgacttggtgagcaaaatctccatggtcacctgggtagctgcatttagaaataggagctgtccagtcaaggttacagcacttgttttctttccttagaattcaatgcagttaaatatcatctgtaaattttgattagctttgcaaggctattgaaggtttgtatattccaatgcctctgattaatcaaattcaattaaaaatgaaaataaagatttatttatataatagtagggaatatatcctcttcttatttattttgagttgaagagatggagataaatccaatagaaaaataacaataataatgttcaaacattttcaacatgtaaagaattgtatttagaactatcaaaaatttatacaataggatgttttatcacagaatctggaaaggagacttctagaaattgagaaatacaggatatttctgatataagactgaatgcaaatgtgtatattctaagaaatacaaaaacaacttggtaaaaaaaaaaaagacacttaaaatgagtgctgtgtgctttcctttctggtttttattatttttaaattgttccttcagccaccaaagttatatgatggtttctgaacagcgtttacttttgtgacagtttcatctcactctgttgtccaaactgataaagtccagaagtctagaaacagcaagggactcccttcctctgttatatgtaagctgacaagaggcagacaaacacgttctgaagttttgtgcatgctgcgttttctctccttgctgcaacaagaaaagcctttgttttccaacctggcaacctttgaagaagtgactcagacatcttcatggcctctaaagatgcccagaaccaaagaagaggtctgcctggttttcttcctggagctccagacccagaccaaagccttcctgcctcttccaatccagggaaccaagcatggcagctgagtctccctctgccaagcagtttcctgccaacagtcagtctccctcctggtctagaatatttaagccagttagacctgataattatacaccagcaggtggagctgcttggaatgatacttggtactgagacctccaacaaatatgagattaaaaacagcttgggacaaagaatttactttgcagtggaggaaagcatctgcttcaatcgtactttctgttccactctgcgatcttgcaccctgaggatcacagataactcaggtcgagaggtcattacagtgaacaggcccttgagatgtaacagctgctggtgcccttgctacctacaagagttagaaatccaagcccctcctggtactatagttggttacgttacgcagaagtgggacccctttctgcctaaattcacaatccaaaatgcaaacaaagaagatattttgaaaattgttggtccttgtgtgacatgtggctgttttggcgatgtggattttgaggtgaaaaccattaatgaaaagcttacaattgggaagatttcaaagtactggtcaggatttgtaaatgatgtcttcacaaatgctgacaatttcggaattcatgttcctgcagatctagatgtaacagtcaaagcagcaatgatcggtgcctgttttctctttgattttatgttctttgaacattcactggctggattataataaccaagataatgaaaacaataaaatatgcagaacatatttcaaaatcccttgggctctggatttcatttctgaatggtttgaatgtttgcttttttgttaaaaaaaaatgttaattattatatttattaaaacagtttaatgaggca

SEQ ID NO: 165956 - DNA, 1058 bp, Homo sapiens
  Payload ID: 12669
  Gene Symbol: PLSCR5
  Gene Name: phospholipid scramblase family, member 5
  Uniprot ID: A0PG75
  ENST ID: ENST00000492200
  CDS Start-End: 28-843
ctttgaagaagtgactcagacatcttcatggcctctaaagatgcccagaaccaaagaagaggtctgcctggttttcttcctggagctccagacccagaccaaagccttcctgcctcttccaatccagggaaccaagcatggcagctgagtctccctctgccaagcagtttcctgccaacagtcagtctccctcctggtctagaatatttaagccagttagacctgataattatacaccagcaggtggagctgcttggaatgatacttggtactgagacctccaacaaatatgagattaaaaacagcttgggacaaagaatttactttgcagtggaggaaagcatctgcttcaatcgtactttctgttccactctgcgatcttgcaccctgaggatcacagataactcaggtcgagaggtcattacagtgaacaggcccttgagatgtaacagctgctggtgcccttgctacctacaagagttagaaatccaagcccctcctggtactatagttggttacgttacgcagaagtgggacccctttctgcctaaattcacaatccaaaatgcaaacaaagaagatattttgaaaattgttggtccttgtgtgacatgtggctgttttggcgatgtggattttgaggtgaaaaccattaatgaaaagcttacaattgggaagatttcaaagtactggtcaggatttgtaaatgatgtcttcacaaatgctgacaatttcggaattcatgttcctgcagatctagatgtaacagtcaaagcagcaatgatcggtgcctgttttctctttgattttatgttctttgaacattcactggctggattataataaccaagataatgaaaacaataaaatatgcagaacatatttcaaattatttagagtatttcaaagcacttccacacatatgaatggcctgcactggacctcacaagaaaacagagggtttcaactgtgcataacatcagagatgaccaggtgcaacctccatatattgaagacttagaaaatgagaaatataaaaattaaattactttgtttta

SEQ ID NO: 165957 - DNA, 1018 bp, Homo sapiens
  Payload ID: 12669
  Gene Symbol: PLSCR5
  Gene Name: phospholipid scramblase family, member 5
  Uniprot ID: A0PG75
  ENST ID: ENST00000482567
  CDS Start-End: 28-807
ctttgaagaagtgactcagacatcttcatggcctctaaagatgcccagaaccaaagaagaggtctgcctggttttcttcctggagctccagacccagaccaaagccttcctgcctcttccaatccagggaaccaagcatggcagctgagtctccctctgccaagcagtttcctgccaacattagacctgataattatacaccagcaggtggagctgcttggaatgatacttggtactgagacctccaacaaatatgagattaaaaacagcttgggacaaagaatttactttgcagtggaggaaagcatctgcttcaatcgtactttctgttccactctgcgatcttgcaccctgaggatcacagataactcaggtcgagaggtcattacagtgaacaggcccttgagatgtaacagctgctggtgcccttgctacctacaagagttagaaatccaagcccctcctggtactatagttggttacgttacgcagaagtgggacccctttctgcctaaattcacaatccaaaatgcaaacaaagaagatattttgaaaattgttggtccttgtgtgacatgtggctgttttggcgatgtggattttgaggtgaaaaccattaatgaaaagcttacaattgggaagatttcaaagtactggtcaggatttgtaaatgatgtcttcacaaatgctgacaatttcggaattcatgttcctgcagatctagatgtaacagtcaaagcagcaatgatcggtgcctgttttctctttgattttatgttctttgaacattcactggctggattataataaccaagataatgaaaacaataaaatatgcagaacatatttcaaattatttagagtatttcaaagcacttccacacatatgaatggcctgcactggacctcacaagaaaacagagggtttcaactgtgcataacatcagagatgaccaggtgcaacctccatatattgaagacttagaaaatgagaaatataaaaattaaattactttgt

SEQ ID NO: 165958 - DNA, 1731 bp, Homo sapiens
  Payload ID: 12670
  Gene Symbol: PLTP
  Gene Name: phospholipid transfer protein
  Uniprot ID: P55058
  ENST ID: ENST00000354050
  CDS Start-End: 86-1411
agaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccag

SEQ ID NO: 165959 - DNA, 1530 bp, Homo sapiens
  Payload ID: 12670
  Gene Symbol: PLTP
  Gene Name: phospholipid transfer protein
  Uniprot ID: P55058
  ENST ID: ENST00000372420
  CDS Start-End: 132-1349
atgtagagggggccaagaaggaagcaggaccagtggatgtgaggcgtggtcgaagaacaacagaaagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 165960 - DNA, 1743 bp, Homo sapiens
  Payload ID: 12670
  Gene Symbol: PLTP
  Gene Name: phospholipid transfer protein
  Uniprot ID: P55058
  ENST ID: ENST00000372431
  CDS Start-End: 81-1562
ccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 165961 - DNA, 1420 bp, Homo sapiens
  Payload ID: 12670
  Gene Symbol: PLTP
  Gene Name: phospholipid transfer protein
  Uniprot ID: P55058
  ENST ID: ENST00000420868
  CDS Start-End: 89-1285
gccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtaccc

SEQ ID NO: 165962 - DNA, 2255 bp, Homo sapiens
  Payload ID: 12670
  Gene Symbol: PLTP
  Gene Name: phospholipid transfer protein
  Uniprot ID: P55058
  ENST ID: ENST00000477313
  CDS Start-End: 596-2077
agtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccacc

SEQ ID NO: 165963 - DNA, 1522 bp, Homo sapiens
  Payload ID: 12671
  Gene Symbol: LHPP
  Gene Name: phospholysine phosphohistidine inorganic pyrophosphate phosphatase
  Uniprot ID: Q9H008
  ENST ID: ENST00000368839
  CDS Start-End: 21-653
gaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 165964 - DNA, 1622 bp, Homo sapiens
  Payload ID: 12671
  Gene Symbol: LHPP
  Gene Name: phospholysine phosphohistidine inorganic pyrophosphate phosphatase
  Uniprot ID: Q9H008
  ENST ID: ENST00000368842
  CDS Start-End: 29-841
gcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 165965 - DNA, 840 bp, Homo sapiens
  Payload ID: 12671
  Gene Symbol: LHPP
  Gene Name: phospholysine phosphohistidine inorganic pyrophosphate phosphatase
  ENST ID: ENST00000392757
  CDS Start-End: 30-668
cgcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccagttactttcagtatgaaagcaagaagcagaaatgcctgcggcttttcctgagtttttgctgcttctctgaaaggataagaattgacaagtcctatcagtgtgttaatatatctcactggcaagacagtgtaacagcaagattacaacaatatggaggaaataataaagtcactcattttgcgaccttt

SEQ ID NO: 165966 - DNA, 1298 bp, Homo sapiens
  Payload ID: 12672
  Gene Symbol: PMM1
  Gene Name: phosphomannomutase 1
  Uniprot ID: Q92871
  ENST ID: ENST00000216259
  CDS Start-End: 86-874
aatgccccgccccgtcagcacttatccctgagctgcttctgccgttgcatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagtaggt

SEQ ID NO: 165967 - DNA, 567 bp, Homo sapiens
  Payload ID: 12672
  Gene Symbol: PMM1
  Gene Name: phosphomannomutase 1
  ENST ID: ENST00000414636
  CDS Start-End: 43-249
gttgcatcttcgggactccgccccgcgcgcggacctgcagccatggcagtcaccgcccaggcagcccgcaggaaggagcgcgtcctctgcctgtttgacgtggacgggaccctcacgccggctcgccagtcgtggagcagagagggcttcttttcaaattcgtttatgagctctacccacccggatgtgagaggctccaggcctagcctgtttgctgtgaggacactgaggaatagtgaggaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacat

SEQ ID NO: 165968 - DNA, 2313 bp, Homo sapiens
  Payload ID: 12673
  Gene Symbol: PMM2
  Gene Name: phosphomannomutase 2
  Uniprot ID: O15305
  ENST ID: ENST00000268261
  CDS Start-End: 67-807
ccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgt

SEQ ID NO: 165969 - DNA, 1557 bp, Homo sapiens
  Payload ID: 12673
  Gene Symbol: PMM2
  Gene Name: phosphomannomutase 2
  ENST ID: ENST00000566540
  CDS Start-End: 42-242
gtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaatattcaaagtcatctgggtgaggccctaatccaagatttaatcaactactgtctgagctacattgcgaaaattaaactcccgaagaagagaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagct

SEQ ID NO: 165970 - DNA, 931 bp, Homo sapiens
  Payload ID: 12673
  Gene Symbol: PMM2
  Gene Name: phosphomannomutase 2
  ENST ID: ENST00000562318
  CDS Start-End: 42-242
gtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaa

SEQ ID NO: 165971 - DNA, 550 bp, Homo sapiens
  Payload ID: 12673
  Gene Symbol: PMM2
  Gene Name: phosphomannomutase 2
  ENST ID: ENST00000568602
  CDS Start-End: 42-317
gtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgcccccctcacctccccatcactgaaacagaatctccagcacaggaccccgaaaaaccagagaggcttattgaccccttcactggagagtctgacttgataggtctgtggagcctgggaatcctatttcatggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgtt

SEQ ID NO: 165972 - DNA, 567 bp, Homo sapiens
  Payload ID: 12673
  Gene Symbol: PMM2
  Gene Name: phosphomannomutase 2
  ENST ID: ENST00000564069
  CDS Start-End: 1-427
cttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggt

SEQ ID NO: 165973 - DNA, 514 bp, Homo sapiens
  Payload ID: 12673
  Gene Symbol: PMM2
  Gene Name: phosphomannomutase 2
  ENST ID: ENST00000565896
  CDS Start-End: 42-239
gtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtacatttctggagttactgatggagaactgggtactcagatgtgtgagtagattcacctagaaagaatctccagcacaggaccccgaaaaaccagagaggcttattgaccccttcactggagagtctgacttgataggtctgtggagcctgggaatcctatttcagggtactttcattgaattccgaaatgggatgttaaacgtgtcccctattggaagaagctgcagccaagaagaacgcattgagttctacgaactcgataaaaaagaaaatataagacaaaagtttgtagca

SEQ ID NO: 165974 - DNA, 573 bp, Homo sapiens
  Payload ID: 12673
  Gene Symbol: PMM2
  Gene Name: phosphomannomutase 2
  ENST ID: ENST00000570134
  CDS Start-End: 46-246
cctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaatattcaaagtcatctgggtgaggccctaatccaagatttaatcaactactgtctgagctacattgcgaaaattaaactcccgaagaagagaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaacccttgcagaggagacaaacagtgatgttttccattcatacacggcgagaggggccagaagcctg

SEQ ID NO: 165975 - DNA, 698 bp, Homo sapiens
  Payload ID: 12673
  Gene Symbol: PMM2
  Gene Name: phosphomannomutase 2
  ENST ID: ENST00000569958
  CDS Start-End: 17-484
gctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatg

SEQ ID NO: 165976 - DNA, 986 bp, Homo sapiens
  Payload ID: 12673
  Gene Symbol: PMM2
  Gene Name: phosphomannomutase 2
  Uniprot ID: O15305
  ENST ID: ENST00000566604
  CDS Start-End: 47-406
tcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagagaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcgg

SEQ ID NO: 165977 - DNA, 1002 bp, Homo sapiens
  Payload ID: 12673
  Gene Symbol: PMM2
  Gene Name: phosphomannomutase 2
  ENST ID: ENST00000570076
  CDS Start-End: 34-306
gtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctg

SEQ ID NO: 165978 - DNA, 793 bp, Homo sapiens
  Payload ID: 12673
  Gene Symbol: PMM2
  Gene Name: phosphomannomutase 2
  ENST ID: ENST00000565221
  CDS Start-End: 17-229
gctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggccc

SEQ ID NO: 165979 - DNA, 907 bp, Homo sapiens
  Payload ID: 12673
  Gene Symbol: PMM2
  Gene Name: phosphomannomutase 2
  ENST ID: ENST00000566983
  CDS Start-End: 205-864
gaactcacgagtcttgcagtcataaagcagcaacataaagcaagctcccaactctagttctccaggcaattcatccaggctgtcccctgcaagctgctcagcccaccagatctgctttggggagcgcattaaacatggttatgcaatgattgggtggcggatgccatagacatctggccctatgacaagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcat

SEQ ID NO: 165980 - DNA, 1280 bp, Homo sapiens
  Payload ID: 12674
  Gene Symbol: PMVK
  Gene Name: phosphomevalonate kinase
  Uniprot ID: Q15126
  ENST ID: ENST00000368467
  CDS Start-End: 307-885
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacactctca

SEQ ID NO: 165981 - DNA, 2250 bp, Homo sapiens
  Payload ID: 12675
  Gene Symbol: PPCDC
  Gene Name: phosphopantothenoylcysteine decarboxylase
  Uniprot ID: Q96CD2
  ENST ID: ENST00000342932
  CDS Start-End: 145-759
agtcagattccgcgggagagcggcagagataccgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagatatggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggta

SEQ ID NO: 165982 - DNA, 464 bp, Homo sapiens
  Payload ID: 12675
  Gene Symbol: PPCDC
  Gene Name: phosphopantothenoylcysteine decarboxylase
  ENST ID: ENST00000569562
  CDS Start-End: 272-464
gatatttgggagcggccccgagacgcgcctggcgcggctggaagtagcagtggtcacaactgagagagccaaacatttctacagcccccaggacattcctgtcaccctctacagcgacgctgatgaatgggagatatggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcg

SEQ ID NO: 165983 - DNA, 926 bp, Homo sapiens
  Payload ID: 12675
  Gene Symbol: PPCDC
  Gene Name: phosphopantothenoylcysteine decarboxylase
  ENST ID: ENST00000568649
  CDS Start-End: 95-580
ccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccaca

SEQ ID NO: 165984 - DNA, 892 bp, Homo sapiens
  Payload ID: 12675
  Gene Symbol: PPCDC
  Gene Name: phosphopantothenoylcysteine decarboxylase
  ENST ID: ENST00000567336
  CDS Start-End: 71-589
cctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggatatggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaac

SEQ ID NO: 165985 - DNA, 757 bp, Homo sapiens
  Payload ID: 12675
  Gene Symbol: PPCDC
  Gene Name: phosphopantothenoylcysteine decarboxylase
  ENST ID: ENST00000564923
  CDS Start-End: 113-502
cgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggaga

SEQ ID NO: 165986 - DNA, 334 bp, Homo sapiens
  Payload ID: 12675
  Gene Symbol: PPCDC
  Gene Name: phosphopantothenoylcysteine decarboxylase
  ENST ID: ENST00000562095
  CDS Start-End: 148-334
gggcctaatacgtggtgctccatacattctggtcgactgtatgaatgaagggggtggcccttgttctccttttagatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagccccc

SEQ ID NO: 165987 - DNA, 1149 bp, Homo sapiens
  Payload ID: 12675
  Gene Symbol: PPCDC
  Gene Name: phosphopantothenoylcysteine decarboxylase
  ENST ID: ENST00000563393
  CDS Start-End: 401-646
agtagctaagcagacatgaggcttgcagctaaggagggaagtcctctctcaagccagcctgtgaagacagcacctgcctgccctgaccctcctgtggcctccaggcctgtggctctggtaacagtttcttcctccctccccgccacccccttcttcttggtgacagctggaagtagcagtggtcacaactgagagagccaaacatttctacagcccccaggacattcctgtcaccctctacagcgacgctgatgaatgggagatatggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcacca

SEQ ID NO: 165988 - DNA, 984 bp, Homo sapiens
  Payload ID: 12676
  Gene Symbol: PPCS
  Gene Name: phosphopantothenoylcysteine synthetase
  ENST ID: ENST00000372556
  CDS Start-End: 6-176
tgcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaagg

SEQ ID NO: 165989 - DNA, 793 bp, Homo sapiens
  Payload ID: 12676
  Gene Symbol: PPCS
  Gene Name: phosphopantothenoylcysteine synthetase
  ENST ID: ENST00000372560
  CDS Start-End: 28-669
gcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcaggtgatgggcgcttctcttccagagatctaatcccatataaccaatcttgggttaatttcctcttgatctggagatggcctttctgcatctgtattcgctaggcacaggggatacagagatgaataagacaccgccctccctcatggacctcaca

SEQ ID NO: 165990 - DNA, 1431 bp, Homo sapiens
  Payload ID: 12676
  Gene Symbol: PPCS
  Gene Name: phosphopantothenoylcysteine synthetase
  Uniprot ID: Q9HAB8
  ENST ID: ENST00000372561
  CDS Start-End: 8-943
gctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaagg

SEQ ID NO: 165991 - DNA, 966 bp, Homo sapiens
  Payload ID: 12676
  Gene Symbol: PPCS
  Gene Name: phosphopantothenoylcysteine synthetase
  Uniprot ID: Q9HAB8
  ENST ID: ENST00000372562
  CDS Start-End: 395-811
gggacgtgactcgactaacatctgggtgtattgctgaagttggaaaaggggaagaaagaaagaaaaagcagcacaaaacccacaagtcccacgggtcaaatggccgagaaacgactcccaaggagtccaagtccagaaaggcccgtacagtggccggtaagggtcaaacatggccagttcttcacccaggctaggaaacgaacgtgagggaacgtgaccctaccagatgcccacccagccggggatccccctcgttgcagtgtcactttcgctgggctctggggcagaacaactacgcatttccagacttggcgagatcgggacctagtgtcaaaagaagggtagtgaaccgcccactcagtacggcgcggcgcgtacaccaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaa

SEQ ID NO: 165992 - DNA, 2471 bp, Homo sapiens
  Payload ID: 12677
  Gene Symbol: PEA15
  Gene Name: phosphoprotein enriched in astrocytes 15
  Uniprot ID: Q15121
  ENST ID: ENST00000360472
  CDS Start-End: 189-581
catcaccggccagccgggtggagtgagcggcgctgggctcgggctccggctccgcgggcggaagaggcggcggcggcggcagaagcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 165993 - DNA, 2694 bp, Homo sapiens
  Payload ID: 12677
  Gene Symbol: PEA15
  Gene Name: phosphoprotein enriched in astrocytes 15
  Uniprot ID: Q15121
  ENST ID: ENST00000368076
  CDS Start-End: 349-804
gcggcggcggcggcggcgggagccgaggaggaggttccggacgctgcttaggaaccggggactcaggagtgcccgcgccctgagcgctcagctccagaggcgggatgctcaccccttcctaattgcagctccgaatattcagatggggacagtgaagcacagatctcaggagtcctaagtattcatggctaccactaagttggatagaatggcctccgcccagactgcctggtgatccctgagcagctctctgcactgctccagaaatcaggaggatttttcagagcccagagagcagatttctccacgagccctaaggaaatctgaatctctggtgaggaaagtgacatggaggatgaaggaaacaagctctgccaagccccaccatggccaggccagaccagcccagtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 165994 - DNA, 1021 bp, Homo sapiens
  Payload ID: 12677
  Gene Symbol: PEA15
  Gene Name: phosphoprotein enriched in astrocytes 15
  ENST ID: ENST00000368077
  CDS Start-End: 146-472
ctccggctccgcgggcggaagaggcggcggcggcggcagaagcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagaacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtcccttttt

SEQ ID NO: 165995 - DNA, 10744 bp, Homo sapiens
  Payload ID: 12678
  Gene Symbol: PAG1
  Gene Name: phosphoprotein membrane anchor with glycosphingolipid microdomains 1
  Uniprot ID: Q9NWQ8
  ENST ID: ENST00000220597
  CDS Start-End: 712-2010
attctccgcggcgcggcggcgagtgctggctgcggtaccctcccgctcgcttgtccgtctgcgcgcccgcgatgtgaccagccgactgggggcgggctggcggctctgcctgcggcagcgcatcggtttttctcctggcaggtccctaattgagccgtgattcccttggagccagagacacccaccaggggctcggagcgccgcgctccggggctggaggcagctgcagcgctcgggtccgcgcggccgggtgcagtagcctcagtcccagccgccgcctcgctgagtcgtgtgccctggcgaatgcccggcgcccggcacagctgagccaaggcgactggtgcagagcggcggcgcctggtcctgcacttgccgctgctgccgggctgtgccggggcggcggcgctgcgcgccggagtttgcagaggctgcctccgagcgccgtccgccaggaagactccctgcctcctgagtcccaaaaacacgagatttttctcctatttcagcagttggccacaacttcattgctgggaaaaggccaagaaagaagagagaactctcaccacaacatttcaaagggaatacattgccagaacttggaatactctactggacaaacatttcctccaaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagttatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgtgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaatatctcttattagcttgaacattttgtgattacttttccctccccggatctagtccttttaaggagtaagtctaaagaatgaggccatgaagtcactatttcctcccacctcagtttgtctcctggtacttagctggcctatcgctttgtgtggcaatacccctgggtcgcttccccactcagccttctgtatctgctgttcacaggacatgccattatgtctttccagtacggatcacagtgctgccatatcacagaccctgccagccggcacagaaccatgcctcgtcacagctctgcccaactcacaggctgccaagatgaggccacaggtccacctagggcggcagatgctggtgctatttgtcacgacttttgccaaaacatgtacactgttgctcacatctttcgtaagaatggttgacactaaggggccatggaaaagcacttttaaaaaattatgtggtggaatcaaactcacagaggcagaaatgttagtgccgtgctctaaccaagtaagcttagtgttccccacagtgatctgtatctggcctgagtctcctcaagcagcaacccccactgtccagcatgtggaaggtagatccttatgacaacaccagacccatagttaccaggaaagaaaaaggaagctgagtgttgtgaaggggaagaaatcctttttataagaagtaatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaaaacaaaaacaaaaaaaaaacctttttaaagtaaattgagtgtaaaatgttttcaccatgaagccattgcaccctctcccccaggaaacagtgcctaaggatgatgtcaagttacagccagtttgctctgatcccccaggacctaagaaaactgtgagtgcttcagcatgcaaaggtagagctaccagataaggagaataacttggccatttatagcaaactgcctgactttggagtgagaaaccaagcaccttctaggtcctaggataggtgaattggaggtgcagctgctgaagttcccattttctacatacttcaggagccagggtgtttcatttggttttgtaaaactttgctgtaagtcatcacagttaattctttgaatggacattttagagtgtaactttttttcaaaattagcagaacagatatctctgctcattctctttatacatttagttttttaaagttcccctagtatacctgttaggcactctaaataggacacagttaaagctaaaagaaggaccagttgctccctagagcctacagttcagaactatcttgttgtcatgtcctggtttggtttggtttgtttttaactcaacaagttggaaaccatgagtttaaagcaaactatttccttttcttaagcttaaagagaattttttttttaatctttagctcctcatttaggtagtgaaggcttccctgaaagacagcagtgcccttctctggaagaagaggctgggaccaaaagcctgagtctatgggttgaggattttgagcattcctttgacaagcttctatgtatttttaatataagactcataaatgaacctgatgtggtgttcatgacccatcccttaagcatgcttgctttttttaactttactttttgagtatagtacttgtcttgtttttcctggagccatgctaggatttaattcctatgtgccactacccgcccatgtcctggaagatggccatgcctgcagcaatgctcatgtcttgaggagaagcaatgtgaaaagcatcaggaaagctgaaccttacgttcaagtcagcaaacatttgtgagcattctagtatgcttgcgaccttgacactttttaaaaattatctttttatttgcttcgagtatcaaccgtatagttgactctagtggggcgaagggagcagagatgagagcaaaattcagacttgctgcccctgtgtgtctcagttctcatgtctctctgagaaatgtgttggcccaattccctatctgccactctgagtctcttgagtaaatgtgtgtaaatgagaaaaattatctcaaagatttaacttattatttagatattttcttctttttaaactcaggaataaacctggtttgtagataatataatatggctactagagctataattgagtaggtgactagaagcattttttcaaatatatttcttgtaaagacatctactttgttttaactaggaaaagaaactcctcatattaaaataaacatttccataagcactttctagaagagtgtagcatccatctaccatccatcccagaatgtttgtatcttgctcatagtatttcaaaaatttttatgggtgaaaaaaatgcacttttttatttattggaaaagtgtagagttattgaattaaattctcaagtgggacaatttagtgtaaagggaaacatgggttttggagacaagagcacagggctgtggtccctgttccagcattgactttactatgtgacctcgagcaaatgatttaacttctctgtgcctcagtttctccatatacaaaatggggataatgatactaaccattgcctacctcatagagatgttatggggacaaacgaaataatagagataagcacgaatgctttcaactcttcggaagaaaggtgctatataaattgaagttgtgtttttaatgatccaattattaattatgtttagggtttaaataacaatactgttagtcatgttaagaataagttttgttttgatgcatatttccacttctcttctgtggccagatcttgatcattcaaccagtaatggtacctgaggaactgaaatgggtatttgttttcgtatgtttctgccagtagtatttcaattgaatatccagaaaagactggagtttaacttgtaatatcttatagtttacatgtaataaaacttattcaagctatatataaaagtatgattacatgtaaatagcaggtatgttgtaattaaaggcacttatcaaattgtctttgttcttttttaattgtaataaaagtcagttttacataaa

SEQ ID NO: 165996 - DNA, 3682 bp, Homo sapiens
  Payload ID: 12679
  Gene Symbol: PPAT
  Gene Name: phosphoribosyl pyrophosphate amidotransferase
  Uniprot ID: Q06203
  ENST ID: ENST00000264220
  CDS Start-End: 139-1692
agtagctggggccaccctcgggaaggaagagcctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagattttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaatttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaa

SEQ ID NO: 165997 - DNA, 808 bp, Homo sapiens
  Payload ID: 12679
  Gene Symbol: PPAT
  Gene Name: phosphoribosyl pyrophosphate amidotransferase
  ENST ID: ENST00000510643
  CDS Start-End: 32-610
gcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagatttcctattgcctccagccatggtcatccgttattagtatatacatactattagcgcaggagtccccaacccctgtgctagggactagtaccagtctgtggcttgttaggaaccaggccacacagcaggaggtgagtgcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattcc

SEQ ID NO: 165998 - DNA, 563 bp, Homo sapiens
  Payload ID: 12679
  Gene Symbol: PPAT
  Gene Name: phosphoribosyl pyrophosphate amidotransferase
  ENST ID: ENST00000507724
  CDS Start-End: 20-238
acgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggt

SEQ ID NO: 165999 - DNA, 942 bp, Homo sapiens
  Payload ID: 12680
  Gene Symbol: PRPS1
  Gene Name: phosphoribosyl pyrophosphate synthetase 1
  ENST ID: ENST00000372418
  CDS Start-End: 17-673
aatcaatgacaatttaatggagcttttgatcatgattaatgcctgcaagattgcttcagccagccgggttactgcagtcatcccatgcttcccttatgcccggcaggataagaaagataagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttca

SEQ ID NO: 166000 - DNA, 628 bp, Homo sapiens
  Payload ID: 12680
  Gene Symbol: PRPS1
  Gene Name: phosphoribosyl pyrophosphate synthetase 1
  ENST ID: ENST00000372419
  CDS Start-End: 100-606
caacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcaggtatcagtggaagctaaatattggtgtttgaaaggtgggaggaaaggactgatgatgctgaagactgcagagaagccaaaaattatgcccaagtacatctgaaataaactagatatcaacaaca

SEQ ID NO: 166001 - DNA, 1748 bp, Homo sapiens
  Payload ID: 12680
  Gene Symbol: PRPS1
  Gene Name: phosphoribosyl pyrophosphate synthetase 1
  ENST ID: ENST00000372428
  CDS Start-End: 410-754
agctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtga

SEQ ID NO: 166002 - DNA, 2073 bp, Homo sapiens
  Payload ID: 12680
  Gene Symbol: PRPS1
  Gene Name: phosphoribosyl pyrophosphate synthetase 1
  Uniprot ID: P60891
  ENST ID: ENST00000372435
  CDS Start-End: 123-1079
gggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtga

SEQ ID NO: 166003 - DNA, 1090 bp, Homo sapiens
  Payload ID: 12681
  Gene Symbol: PRPS1L1
  Gene Name: phosphoribosyl pyrophosphate synthetase 1-like 1
  ENST ID: ENST00000506618
  CDS Start-End: 82-1038
attagagtctgtgcttcacttccgttccagcctcagcggcagctggatcgctcgacggagtgcctctggtagttggccaagacgccgaatatcaaaatcttcagcggcagctcccaccaggacttatcccagaaaattgctgaccgcctgggcctggagctaggcaaggtggtgactaagaaattcagcaaccaggagacctgcgtggaaattgatgagagtgtgcgtggagaggatgtctacatcgttcagagtggttgtggcgaaatcaacgacagtctaatggagcttttgatcatgattaatgcctgcaagattgcttcagctagccgagttactgcagtcatcccatgcttcccttatgcccgacaggataagaaggataagagccggtccccaatctctgccaagcttgttgcaaatatgctctctatagcaggtgcggatcatatcatcaccatggacctacatgcttctcaaattcagggcttttttgatatcccagtagacaacttgtatgcagagccaactgtcctgaagtggataagggagaatatccctgagtggaagaactgcattattgtctcgccagatgctggtggagctaaaagagtgacctccattgcagaccagttgaatgtggactttgctttgattcataaagaacggaagaaggccaatgaagtggactgcatagtgctagtgggagatgtgaatgatcgtgtggctatccttgtagatgacatggcagacacttgtgttacaatctgcctcgcagctgacaaacttctctcagctggagcaaccagagtttatgctatcttgactcatggaatcttttctggcccagccatttctcgcatcaacactgcatgctttgaagcagtggtagtcaccaataccatacctcaagatgagaagatgaagcattgctccaaaatacgagtaattgacatctccatgatccttgcagaagccataaggagaactcataatggggaatctgtttcctacctgttcagccatgttcctttataacagaataacttctaggttatgctattttaaaataaaataagattaataaaaa

SEQ ID NO: 166004 - DNA, 584 bp, Homo sapiens
  Payload ID: 12682
  Gene Symbol: PRPS2
  Gene Name: phosphoribosyl pyrophosphate synthetase 2
  ENST ID: ENST00000380663
  CDS Start-End: 144-584
tcctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggaaaacattgccgagtggaagaactgtatcattgt

SEQ ID NO: 166005 - DNA, 2511 bp, Homo sapiens
  Payload ID: 12682
  Gene Symbol: PRPS2
  Gene Name: phosphoribosyl pyrophosphate synthetase 2
  Uniprot ID: P11908
  ENST ID: ENST00000380668
  CDS Start-End: 129-1085
cctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttca

SEQ ID NO: 166006 - DNA, 1348 bp, Homo sapiens
  Payload ID: 12682
  Gene Symbol: PRPS2
  Gene Name: phosphoribosyl pyrophosphate synthetase 2
  Uniprot ID: P11908
  ENST ID: ENST00000398491
  CDS Start-End: 93-1058
gctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctt

SEQ ID NO: 166007 - DNA, 891 bp, Homo sapiens
  Payload ID: 12682
  Gene Symbol: PRPS2
  Gene Name: phosphoribosyl pyrophosphate synthetase 2
  ENST ID: ENST00000461630
  CDS Start-End: 1-522
tgtttcccatacgcccgacaagataaaaaggacaaggtaggagagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaaggctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaa

SEQ ID NO: 166008 - DNA, 763 bp, Homo sapiens
  Payload ID: 12682
  Gene Symbol: PRPS2
  Gene Name: phosphoribosyl pyrophosphate synthetase 2
  ENST ID: ENST00000489404
  CDS Start-End: 11-613
gcgccccaccatgcccaacatcgtgctgttcagcggcagctcgcatcaggacctgtcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaaggtatcatgcaggctacaccttgcagatttctccatctgctgattggtttttccttttccgatgtattagataaggaagcatgctgtaaattacttaaagctttattttgctaatgagcaagtaagtagaccgcaggcttcacttccagagcagaaacccatcatctttgttaatatttcgtcattcaggaaagaagaaaatacagagacacacatacacaata

SEQ ID NO: 166009 - DNA, 1678 bp, Homo sapiens
  Payload ID: 12683
  Gene Symbol: PRPSAP1
  Gene Name: phosphoribosyl pyrophosphate synthetase-associated protein 1
  ENST ID: ENST00000324684
  CDS Start-End: 222-1070
agagctagatcgtatacctcctcggaggcggacatgttgggtcctggccaaaaagttggaaacacctggggccactaccgaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgt

SEQ ID NO: 166010 - DNA, 1003 bp, Homo sapiens
  Payload ID: 12683
  Gene Symbol: PRPSAP1
  Gene Name: phosphoribosyl pyrophosphate synthetase-associated protein 1
  ENST ID: ENST00000436498
  CDS Start-End: 532-1003
cccgccccacctcctgcacctggggcgggaggcgcgggccttcccagccggacaaagcttggaggtgacggataccgccccccgctccccggttttgcagctgggaggcttggggcggactctcggtgacctcagccccccgccccgtgactgggtccgcggcctgcctgcctttcgtctccgcagtcccacaccccggggcgggccgagctttctggagccccggagtgcgtgtcttggggaaaggggctcagggcttggcttcctttcccacggctggagttgacctgggaatctgaccgccgccactctcaagtctcactgcagtgagacccgcgggcgtggttgtgagttgggggatccgacgcggcaggtgcggtcgcagagcaaaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccat

SEQ ID NO: 166011 - DNA, 916 bp, Homo sapiens
  Payload ID: 12683
  Gene Symbol: PRPSAP1
  Gene Name: phosphoribosyl pyrophosphate synthetase-associated protein 1
  ENST ID: ENST00000435555
  CDS Start-End: 227-916
ctgggtaacacggagcactcaggaatacacgatcttggcggggcgtgatggctgaggcctgtaatgtcggcattttgaatgactgaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgag

SEQ ID NO: 166012 - DNA, 908 bp, Homo sapiens
  Payload ID: 12683
  Gene Symbol: PRPSAP1
  Gene Name: phosphoribosyl pyrophosphate synthetase-associated protein 1
  ENST ID: ENST00000442767
  CDS Start-End: 596-908
ccgggccacgagctggttcccgcccgggtcctaggaagcggcaagcgcgcccccgccgctcgtcctaggcgtctggctagaaggcggcgccgcgacctggccgggtgagctgaggcggcaggccgcgaggcgcggagtcccgggcccggccgcgagcgcagtgtctggggcgcgcgaaagcgaccgcgcagcgcagacggaggcgcgggctccgcgcgaactcgtgtcggagcgagcgccgggcgcgcgcggctccgctctcccgggggacccttggtttcacctcgacgccacgacctcgcccccgcgggtgctgtcggcgccgggatgcagcgccccttttgcgcgctctgccctagcccacccgaaattcgaggcccgcacgccacccggggcgcctctccaggccggggcgtctcgcccgccgcccaccagcttccctctttcttcctcccccgcgctcccacggaggttatttttaacttcccgacgctgcagctgggctaccgagcctgaggccgcctagcgcgctgtcccgggtagagcaggcgacaggccgggggctccgagccggagaggaggcttgacagtgtagatgggcctgggggcccccgtcgggattggaaagccaagcatgtggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgc

SEQ ID NO: 166013 - DNA, 549 bp, Homo sapiens
  Payload ID: 12683
  Gene Symbol: PRPSAP1
  Gene Name: phosphoribosyl pyrophosphate synthetase-associated protein 1
  ENST ID: ENST00000423915
  CDS Start-End: 281-549
ctcagcgcgccgcctccggcacggcccgcgcccacggccgggccacgagctggttcccgcccgggtcctaggaagcggcaagcgcgcccccgccgctcgtcctaggcgtctggctagaaggcggcgccgcgacctggccgggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaaga

SEQ ID NO: 166014 - DNA, 3660 bp, Homo sapiens
  Payload ID: 12683
  Gene Symbol: PRPSAP1
  Gene Name: phosphoribosyl pyrophosphate synthetase-associated protein 1
  Uniprot ID: Q14558
  ENST ID: ENST00000446526
  CDS Start-End: 447-1604
aaaaagttggaaacacctggggccactaccgaggtaggctgctcctcccaagaaagtgagaccgaaagagctcccgtggaagcggtcaaagcaggggcggggcgaacctgtgacatgcccctcggaagaacaggcttttagagagtcgccaggctccctgccctcatccgagatggcggcctgagggcgctctagccgacgctcttcggatgcccggagggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtcttgctagtcttttcattagacagcagaagaccatggatacagaacagcagtcaggtctgtggctggacacaaacactttcccaggttccaccctcttcctaagtgttgaagctaaatccttgttgaatactgtattttaaatctttaaaaaaaaaaaaaaaaagtctaggtgtggtggctcacacctataatctgagtactttgggaggctgaggcaaggaggattgcttgagcccaggagtttcagaccagcctgggaaacatggcgaaacccccatgtctacaaaaaatacaaaaattagccaggcattggtagcatgtgcctgtagttccagctaccttgggaggctgaggtgggaggattgcctgagccaaggaggttgaagctgcagtgaactatgattgtaccactgccatccatcctgggtgacagagcaacaccctgtctcaaaaaaaaaaaacaggccagggatcgtgtcttatgcctgtaatccctgcactttgggaggccgaggcaggtagatcacctgaggtcaggagtttgagaccagcctggccaacatggcaaaaccccgtctctactaaaaatacaaaaattagcctagctaagttaaaagcataaaaagactacaaagaggccaggcatcatggctcacgcctgtaatcccagcactttgggaggccgaggtgggcagatcacttgaggtcaggagtttgagaccagcctggccaatatggtgaaaccctgtccctactaaaaatacaaaaattagccgggtgttgggggagggggtgcacgcctgtaatcccagctactcgggaggctgaggcaggagaattaattggttgaacccaagaggcagagattgcagtgagctgagattgtgccactgcactccagcccaagtgacagagcaagattccatctcaaaaaaaaaaaaagactgcaaagaactagttattttgataaccccttaaaggcctactgtgtcccaagttattggaatataatgatgatcgaaaatccttcaattaaataaacagtacctctcaggctgaagtgaaaaatctgaacttgaacagtagttaaaatagtacagttattccttacaatccatgggtgattggttccaggactcaacctcctgcccatggatgtgcaagtccctgatagaaaatggtgtagtatctgcatataagctatgcacatcctggatgacttgtaatacctactgcaatatcctgtgtagatggtggtcatgctgtattatttagagaatcatgacaggaatctgtacgtgttcagtcgtggttggttaaatctgcagatgcagagctcacggaggaggctggccatgcatggcacacattcataggttctctttaagtagccttgctgtgcttctgttaggaagttttatttatacgtttttgggaagaatcttgt

SEQ ID NO: 166015 - DNA, 1910 bp, Homo sapiens
  Payload ID: 12684
  Gene Symbol: PRPSAP2
  Gene Name: phosphoribosyl pyrophosphate synthetase-associated protein 2
  Uniprot ID: O60256
  ENST ID: ENST00000268835
  CDS Start-End: 284-1393
cgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaa

SEQ ID NO: 166016 - DNA, 1540 bp, Homo sapiens
  Payload ID: 12684
  Gene Symbol: PRPSAP2
  Gene Name: phosphoribosyl pyrophosphate synthetase-associated protein 2
  ENST ID: ENST00000395656
  CDS Start-End: 158-394
accgcggacgccaatcttgtgcatggagtcgccattttgctcctagagaggccgccaggagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgc

SEQ ID NO: 166017 - DNA, 1491 bp, Homo sapiens
  Payload ID: 12684
  Gene Symbol: PRPSAP2
  Gene Name: phosphoribosyl pyrophosphate synthetase-associated protein 2
  Uniprot ID: O60256
  ENST ID: ENST00000419071
  CDS Start-End: 206-1195
gttgtgaccggagttagatgccagcgcagaagggacgtgagcccagccgaggtaccgctgaagaggaatcaattttggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaag

SEQ ID NO: 166018 - DNA, 700 bp, Homo sapiens
  Payload ID: 12684
  Gene Symbol: PRPSAP2
  Gene Name: phosphoribosyl pyrophosphate synthetase-associated protein 2
  ENST ID: ENST00000441887
  CDS Start-End: 280-700
atctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactc

SEQ ID NO: 166019 - DNA, 1014 bp, Homo sapiens
  Payload ID: 12684
  Gene Symbol: PRPSAP2
  Gene Name: phosphoribosyl pyrophosphate synthetase-associated protein 2
  ENST ID: ENST00000432893
  CDS Start-End: 211-1014
acatgccaacatgtgacgcgtggaatctacgccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtg

SEQ ID NO: 166020 - DNA, 1038 bp, Homo sapiens
  Payload ID: 12684
  Gene Symbol: PRPSAP2
  Gene Name: phosphoribosyl pyrophosphate synthetase-associated protein 2
  ENST ID: ENST00000422237
  CDS Start-End: 306-1038
agtctctgctgcctggaccttaaattctgatggggaaatctttttaccaaggttatatctcttgtctggaaggtaaaggctgaggcccagcaaggacaagtgatgtccacatggcctagtagctggaaggcaaacccaactcttcacactcctacttcagccatctttaagtagaaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatcccca

SEQ ID NO: 166021 - DNA, 968 bp, Homo sapiens
  Payload ID: 12684
  Gene Symbol: PRPSAP2
  Gene Name: phosphoribosyl pyrophosphate synthetase-associated protein 2
  ENST ID: ENST00000412418
  CDS Start-End: 165-968
cgcagtcaccgcggacgccaatcttgtgcatggagtcgccattttgctcctagagaggccgccaggagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtg

SEQ ID NO: 166022 - DNA, 950 bp, Homo sapiens
  Payload ID: 12684
  Gene Symbol: PRPSAP2
  Gene Name: phosphoribosyl pyrophosphate synthetase-associated protein 2
  ENST ID: ENST00000419284
  CDS Start-End: 423-950
cctcgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagag

SEQ ID NO: 166023 - DNA, 908 bp, Homo sapiens
  Payload ID: 12684
  Gene Symbol: PRPSAP2
  Gene Name: phosphoribosyl pyrophosphate synthetase-associated protein 2
  ENST ID: ENST00000455992
  CDS Start-End: 205-690
ggccgccaggagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctgatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggtatgtagacctcttt

SEQ ID NO: 166024 - DNA, 787 bp, Homo sapiens
  Payload ID: 12684
  Gene Symbol: PRPSAP2
  Gene Name: phosphoribosyl pyrophosphate synthetase-associated protein 2
  ENST ID: ENST00000414602
  CDS Start-End: 204-787
gccagccacagcagagaggtgggggttgtgaccggagttagatgccagcgcagaagggacgtgagcccagccgaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagag

SEQ ID NO: 166025 - DNA, 1047 bp, Homo sapiens
  Payload ID: 12684
  Gene Symbol: PRPSAP2
  Gene Name: phosphoribosyl pyrophosphate synthetase-associated protein 2
  Uniprot ID: O60256
  ENST ID: ENST00000542013
  CDS Start-End: 49-1011
cagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactgg

SEQ ID NO: 166026 - DNA, 1872 bp, Homo sapiens
  Payload ID: 12684
  Gene Symbol: PRPSAP2
  Gene Name: phosphoribosyl pyrophosphate synthetase-associated protein 2
  Uniprot ID: O60256
  ENST ID: ENST00000536323
  CDS Start-End: 432-1283
agctaggtgcctccgctgtccgggctctagtcccgccctcgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaa

SEQ ID NO: 166027 - DNA, 1019 bp, Homo sapiens
  Payload ID: 12684
  Gene Symbol: PRPSAP2
  Gene Name: phosphoribosyl pyrophosphate synthetase-associated protein 2
  ENST ID: ENST00000574451
  CDS Start-End: 1-782
tggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccacctggagtgcagtggtgcaatcatggcacactgcaacctcggcctcccaggttcaggcgattctcctgggtagctgggactaccggtacatgccaccatgcccagtgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctc

SEQ ID NO: 166028 - DNA, 561 bp, Homo sapiens
  Payload ID: 12684
  Gene Symbol: PRPSAP2
  Gene Name: phosphoribosyl pyrophosphate synthetase-associated protein 2
  ENST ID: ENST00000576355
  CDS Start-End: 250-561
ccctcccttcttcctctcccgccaggggtcggcgggggcgggggacgggcgtccggtgcctgggctctctcctctccctgaggcgccgctggggagtcgaaccctgatgatgggacctgtggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatc

SEQ ID NO: 166029 - DNA, 584 bp, Homo sapiens
  Payload ID: 12684
  Gene Symbol: PRPSAP2
  Gene Name: phosphoribosyl pyrophosphate synthetase-associated protein 2
  ENST ID: ENST00000573253
  CDS Start-End: 191-334
agatgccagcgcagaagggacgtgagcccagccgaggtaccgctgaagaggaatcaattttggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagactttttccccctttctcttctctaggcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggc

SEQ ID NO: 166030 - DNA, 556 bp, Homo sapiens
  Payload ID: 12684
  Gene Symbol: PRPSAP2
  Gene Name: phosphoribosyl pyrophosphate synthetase-associated protein 2
  ENST ID: ENST00000575102
  CDS Start-End: 490-556
agtcgccattttgctcctagagaggccgccaggagacccggcgctttcttccttctgcagctgaggctgcggcggggccggggctggggtcggggccagaattcagcggggtgccaagtcgttttctgtgtgggttgagagacaggctgtgcagcccactgttgcataggactaactactacaaatcatgctgagaccgagctatttttgctgcttagaggctttgcagccttgagttatatctcttgtctggaaggtaaaggctgaggcccagcaaggacaagtgatgtccacatggcctagtagctggaaggcaaacccaactcttcacactcctacttcagccatctttaagtagaaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgt

SEQ ID NO: 166031 - DNA, 1835 bp, Homo sapiens
  Payload ID: 12684
  Gene Symbol: PRPSAP2
  Gene Name: phosphoribosyl pyrophosphate synthetase-associated protein 2
  ENST ID: ENST00000492129
  CDS Start-End: 209-445
ggggttgtgaccggagttagatgccagcgcagaagggacgtgagcccagccgaggtaccgctgaagaggaatcaattttggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatcta

SEQ ID NO: 166032 - DNA, 567 bp, Homo sapiens
  Payload ID: 12684
  Gene Symbol: PRPSAP2
  Gene Name: phosphoribosyl pyrophosphate synthetase-associated protein 2
  ENST ID: ENST00000574522
  CDS Start-End: 288-567
agagaggtgggggttgtgaccggagttagatgccagcgcagaagggacgtgagcccagccgaggtaccgctgaagaggaatcaattttgatgaggaaacaagctcagagggttgaaatgacttgtccaaggttacaggccagtggaggcttgaacccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgt

SEQ ID NO: 166033 - DNA, 504 bp, Homo sapiens
  Payload ID: 12684
  Gene Symbol: PRPSAP2
  Gene Name: phosphoribosyl pyrophosphate synthetase-associated protein 2
  ENST ID: ENST00000575228
  CDS Start-End: 334-504
gcagtcaccgcggacgccaatcttgtgcatggagtcgccattttgctcctagagaggccgccaggagacccggcgctttcttccttctgcagctgaggctgcggcggggccggggctggggtcggggccagatggagtcttgctgtgtcgccaggctggaagtgcagtggcacgatctcagctcactgcaacctctgcctcccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcat

SEQ ID NO: 166034 - DNA, 927 bp, Homo sapiens
  Payload ID: 12684
  Gene Symbol: PRPSAP2
  Gene Name: phosphoribosyl pyrophosphate synthetase-associated protein 2
  ENST ID: ENST00000487101
  CDS Start-End: 248-484
gaagggacgtgagcccagccgaggtaccgctgaagaggaatcaattttgatgaggaaacaagctcagagggttgaaatgacttgtccaaggttacaggccagtggaggcttgaacccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatcccca

SEQ ID NO: 166035 - DNA, 927 bp, Homo sapiens
  Payload ID: 12684
  Gene Symbol: PRPSAP2
  Gene Name: phosphoribosyl pyrophosphate synthetase-associated protein 2
  ENST ID: ENST00000570450
  CDS Start-End: 400-927
gagaggtgggggttgtgaccggagttagatgccagcgcagaagggacgtgagcccagccgaggtaccgctgaagaggaatcaattttggtatgcagataatcactgggctcatgggtcttgctctttacaaagagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagag

SEQ ID NO: 166036 - DNA, 570 bp, Homo sapiens
  Payload ID: 12684
  Gene Symbol: PRPSAP2
  Gene Name: phosphoribosyl pyrophosphate synthetase-associated protein 2
  ENST ID: ENST00000460724
  CDS Start-End: 1-430
agaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttg

SEQ ID NO: 166037 - DNA, 537 bp, Homo sapiens
  Payload ID: 12684
  Gene Symbol: PRPSAP2
  Gene Name: phosphoribosyl pyrophosphate synthetase-associated protein 2
  ENST ID: ENST00000571907
  CDS Start-End: 295-438
agtcccgccctcgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagactttttccccctttctcttctctaggcggctaggggtggagatgggcaaagtgcaggtttaccaggaacctaacagagaaacaagagtacaaattcaagagtctgtgaggggaaaagatgtttt

SEQ ID NO: 166038 - DNA, 1905 bp, Homo sapiens
  Payload ID: 12684
  Gene Symbol: PRPSAP2
  Gene Name: phosphoribosyl pyrophosphate synthetase-associated protein 2
  Uniprot ID: O60256
  ENST ID: ENST00000610773
  CDS Start-End: 465-1316
acatgccaacatgtgacgcgtggaatctacgccagccacagcagagaggtgggggttgtgaccggagttagatgccagcgcagaagggacgtgagcccagccgaggtaccgctgaagaggaatcaattttggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaa

SEQ ID NO: 166039 - DNA, 192 bp, Homo sapiens
  Payload ID: 12684
  Gene Symbol: PRPSAP2
  Gene Name: phosphoribosyl pyrophosphate synthetase-associated protein 2
  ENST ID: ENST00000628609
  CDS Start-End: 49-192
cagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagactttttccccctttctcttctctag

SEQ ID NO: 166040 - DNA, 1944 bp, Homo sapiens
  Payload ID: 12685
  Gene Symbol: PRTFDC1
  Gene Name: phosphoribosyl transferase domain containing 1
  Uniprot ID: Q9NRG1
  ENST ID: ENST00000320152
  CDS Start-End: 30-707
cttcccttcccgcgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcagagatctgaatcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaacttgttatgttttatcacttc

SEQ ID NO: 166041 - DNA, 741 bp, Homo sapiens
  Payload ID: 12685
  Gene Symbol: PRTFDC1
  Gene Name: phosphoribosyl transferase domain containing 1
  Uniprot ID: Q9NRG1
  ENST ID: ENST00000376376
  CDS Start-End: 18-539
cgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggctgcgtgctcggttgaagaggacaaccatctgtgatagaggaggactggccttcagtcaagggtatatgagtagctgtgctcccctgcaagaatctccaaataccctctggagaggttacctccaagtgctcattccctgtttccacatccggtttcagttaccaagatcagagcagaattaggtctgagatccagtgaggtgtacagtagcacctggaccattctagggctcactgtcttcaagccctggctgtgcccacagtcttcatgaagaaactggacactgtgtctgctggatgatgtatttcttcttgcttgaggttatgaaaaatatcaaaatatgtaaagaaacatgctggataaaaatattgccttgaaatacaa

SEQ ID NO: 166042 - DNA, 747 bp, Homo sapiens
  Payload ID: 12685
  Gene Symbol: PRTFDC1
  Gene Name: phosphoribosyl transferase domain containing 1
  Uniprot ID: Q9NRG1
  ENST ID: ENST00000376378
  CDS Start-End: 10-582
gggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagag

SEQ ID NO: 166043 - DNA, 3339 bp, Homo sapiens
  Payload ID: 12686
  Gene Symbol: PAICS
  Gene Name: phosphoribosylaminoimidazole carboxylase, phosphoribosylaminoimidazole succinocarboxamide synthetase
  Uniprot ID: P22234
  ENST ID: ENST00000264221
  CDS Start-End: 232-1509
gctagccttcccctaagagctgcctggaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggt

SEQ ID NO: 166044 - DNA, 3297 bp, Homo sapiens
  Payload ID: 12686
  Gene Symbol: PAICS
  Gene Name: phosphoribosylaminoimidazole carboxylase, phosphoribosylaminoimidazole succinocarboxamide synthetase
  Uniprot ID: P22234
  ENST ID: ENST00000399688
  CDS Start-End: 176-1474
agtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcagttacctcatataagtcaaatcgtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 166045 - DNA, 6480 bp, Homo sapiens
  Payload ID: 12686
  Gene Symbol: PAICS
  Gene Name: phosphoribosylaminoimidazole carboxylase, phosphoribosylaminoimidazole succinocarboxamide synthetase
  Uniprot ID: P22234
  ENST ID: ENST00000512576
  CDS Start-End: 162-1439
cccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgagtatttatactttctacgggcttgtaggtaaacataaaaagagaaaaaatatcccaataatacagtttttaaccttttatgataaagacatgcttagaattgctgttaagctttctgagatttaaccactgaaactaagtaaaagacaaagcacttaggtaaagcttcattcagtatccattcacccaatactggtttgattctagggcctaggaaaataggactgagcaaagcccttgtccagatggaacttatgttttagaggggaaaacaaaccataaaaaggtaaacagtataaaatcaggaaaggataaatgtatatgaagaatcaaaatgaggacggtgatggggataagaggggaaggtttttgaggagagcagagcaatgatgtaaaagcaagacacacagatagggaaatagctttccatactaagggaatgggaaataaagctgagttttgccttgaggacctccaaacatgagaattgctagagctctgtgaacaaggatgagagtggaagacaatataagcaaaggctacatcacttagggcctataggccacactgaagtgtgacaggaaaaactcagtttgagcagaggcttgacatacttaacatatttaaaggttctctggctgttgtgtggacaagaggagaagcagagattagttaagaggctattgtagcccaggtgagggatgatgtatgatcttcaacatgtctaatttttttgtgcctcaatttcatgaaatgaaaatgcgactaataccacctcataaagttgtgagaattacatgagtcaatatatgtaaggcccatcatggcacacaaatgtgttatgtaatatccatttggcagactgaagaacaacagtatgaatggaattcattcaccatgagaattacctggaattctctgggcatggtagctcatgcctgtaatcccagcactttgggtggccgaggcaggtggatcacctgagatcaggagttcgagaccagcctgaccaacatggagaaacccagtctctaataaaaatacaaaactagccgggcatggtggcacattcctgtaatcccagcgactcaggaggctgaggcaggagaatcgcttgaacctgggaagcggaggttgtggtgagccgaggttgcgccattgtactccagcctgggcaacaagagcaaaactctgtttcaaaaaaaaagaaagaaagaaaattacctggaattcaatattgccatcggctgatttaatttctaatatgaagaaaggggcagtgtgatgtgccacggagcatccacaacctgccatttcagcccagccaaccttagaaagccattgaaaagagttgtttttaatggtgtttttacatccagcttcccacacctcaaatacttggggtggaattgttaatctcacattgcagtacaatgaaaatagtggaatggaaatcaagttataaaatggagctaaatatttcttctgcttgcctctgagttgataagataccataagatactgtacatgaggctgggcgcggtggctcacgtcttatttcttctgcttgcctctgagttgacaagataccataagatactgtacatgaggctgggtgcagtggctcacgcctgtaatcccagcactttgggagggtgaggtgggcagatcacctgaggtcgggagttcaagaccagcctgactgacatggagaaaccccctctttactaaaaatacaaaattagccaggcatggtggtgcatgcctataattccaactactcgggaggctgaggcaggagaatcgcttgaacctggaaggcagaggttgtggtgagctgagatcgaaccattgcactccagcctgggcaacaagagcgaaaatctgtcgccaaaaaaaaaaaaaaaaagatactgtacatggaagcttctcaggctaaatccattaatataaaaatacattgtggatactgatgagatggctaattctgtcaacttgactaggctacgggatgccttgatagctggtcaaacaacatttctaggtacatctgtgatggtgtttctggaagagactagcacttgaatcagtagacttgagtaaagaagactgccttcacccatgtgggtgagcgtcatctaatccattgagggcctgaatagaacaaaaaaggggaagaagggtgaactgctgggacatccatttcgtgcccccagatgttggtgctcctggtcctcaggccttcagactaggacttaacgttattgcctcccctgattctcaagccctcgggtttggaactacactggctttcctgggccttcagcctgcagaaggcagactgtgggacttcacctccattttgcagagccaatttctcataatctgtacatatcctattggttctgtattttttagagaacaaatacagcctattatgtatatataagaccctgggaatgcaaagatgaacaaaattaaccttctgctctcaatgaatcttggaagtctccagaggcagacaatttcaaaacaccgtatatagtcttaatatggaattaacaatagggtattgtgaatacacaaaagtaggaaggactctgatctctagaaaacaattgtatactgtgaatgaaaaagactaattctccacagtctatactcaatctctcttacctttccataattttcttcagcaaacttattaccaccaaacatagtacatgtttatttattacccatctctcccaactagaaaataaatgtattacactggg

SEQ ID NO: 166046 - DNA, 1514 bp, Homo sapiens
  Payload ID: 12686
  Gene Symbol: PAICS
  Gene Name: phosphoribosylaminoimidazole carboxylase, phosphoribosylaminoimidazole succinocarboxamide synthetase
  ENST ID: ENST00000505164
  CDS Start-End: 276-1514
agccttcccctaagagctgcctggaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttggtacgctccaacttctgagtcgctcccgcagccgagaaggggccgggagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttg

SEQ ID NO: 166047 - DNA, 3340 bp, Homo sapiens
  Payload ID: 12686
  Gene Symbol: PAICS
  Gene Name: phosphoribosylaminoimidazole carboxylase, phosphoribosylaminoimidazole succinocarboxamide synthetase
  ENST ID: ENST00000514888
  CDS Start-End: 516-1517
agggtggagctagccttcccctaagagctgcctggaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 166048 - DNA, 5371 bp, Homo sapiens
  Payload ID: 12687
  Gene Symbol: PFAS
  Gene Name: phosphoribosylformylglycinamidine synthase
  Uniprot ID: O15067
  ENST ID: ENST00000314666
  CDS Start-End: 134-4150
aacaaacgcgcgcgacgattcgaggtgctctgtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatccaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccagggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcccctccccgccttttcaataaaggatgaatgaaggttg

SEQ ID NO: 166049 - DNA, 2652 bp, Homo sapiens
  Payload ID: 12687
  Gene Symbol: PFAS
  Gene Name: phosphoribosylformylglycinamidine synthase
  ENST ID: ENST00000546020
  CDS Start-End: 1-1157
ggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggtcaggcccaaggaaggctgggggagggcccgagggttgggggcaagggtgggcatgaaggaccttggctctcacttccctcctccttccatcccaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcccctccccgccttttcaataaaggatgaatgaaggttgactgca

SEQ ID NO: 166050 - DNA, 349 bp, Homo sapiens
  Payload ID: 12687
  Gene Symbol: PFAS
  Gene Name: phosphoribosylformylglycinamidine synthase
  ENST ID: ENST00000583059
  CDS Start-End: 1-349
gcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagatagtgctggtggacgatcgggagtgtcctgtcagaagaaatggccagggggatgc

SEQ ID NO: 166051 - DNA, 553 bp, Homo sapiens
  Payload ID: 12687
  Gene Symbol: PFAS
  Gene Name: phosphoribosylformylglycinamidine synthase
  ENST ID: ENST00000581242
  CDS Start-End: 244-553
gagtatagttaccgcgtgcggacctggatcctcctccaggtgcagcgtttcgtcatctagcccaagcttggtctggcggcttcagtatccccaccgggccgagctgtgtctacttggtgcccgcgtatttgctttagtggaggcgtccattcgtcctatcttgcgaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaaca

SEQ ID NO: 166052 - DNA, 765 bp, Homo sapiens
  Payload ID: 12687
  Gene Symbol: PFAS
  Gene Name: phosphoribosylformylglycinamidine synthase
  ENST ID: ENST00000578979
  CDS Start-End: 1-188
agaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgctgaactggatggaactggctgacacccaccatgttcctgactgcacccctctgagacttcccatccctgagatgtccatgatgaaacatcctcagtcctgccgtcctagccctcatcctccctgatccctaccctactctctggctgcatccctctgaccctcaccctggcccttcctgcatttccctgatcccgccccaactcccttggcccttcttgcatccccctgactccccacattgctctcccagtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtg

SEQ ID NO: 166053 - DNA, 581 bp, Homo sapiens
  Payload ID: 12687
  Gene Symbol: PFAS
  Gene Name: phosphoribosylformylglycinamidine synthase
  ENST ID: ENST00000585183
  CDS Start-End: 319-581
gctttttgccttctacacgcacttcgggtctcagacgcttttacttattatggttgcccttttcccctacagctccgtcaagggtcttctccaggaacccacagccccatagttcccccattaacctgctcctggtttcccaccaggattaaaccctagagagtgaacggagaccagtttaaggctcacagcgggcgccgcgtgaatgagggaataaacattcgcagaaccagtaagaggaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgct

SEQ ID NO: 166054 - DNA, 4242 bp, Homo sapiens
  Payload ID: 12687
  Gene Symbol: PFAS
  Gene Name: phosphoribosylformylglycinamidine synthase
  ENST ID: ENST00000580356
  CDS Start-End: 134-529
aacaaacgcgcgcgacgattcgaggtgctctgtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatccaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccagggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgt

SEQ ID NO: 166055 - DNA, 557 bp, Homo sapiens
  Payload ID: 12687
  Gene Symbol: PFAS
  Gene Name: phosphoribosylformylglycinamidine synthase
  ENST ID: ENST00000584044
  CDS Start-End: 151-557
aacaaacgcgcgcgacgattcgaggtgctctgtggccgcgagtgcatcttccacttaatgttattttttaggaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctga

SEQ ID NO: 166056 - DNA, 396 bp, Homo sapiens
  Payload ID: 12687
  Gene Symbol: PFAS
  Gene Name: phosphoribosylformylglycinamidine synthase
  ENST ID: ENST00000625942
  CDS Start-End: 1-396
atgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcggtctggctttag

SEQ ID NO: 166057 - DNA, 2149 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000361093
  CDS Start-End: 92-1393
ccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagtctcattttatcactgcgtttgtatctattactaaaatgtattttttgacctcttactgattcattgttggtatgtacaaactgttgacttgtaaaatcaataaagtcttagttggaaa

SEQ ID NO: 166058 - DNA, 3341 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000381815
  CDS Start-End: 116-3148
tggtcccgcgccggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 166059 - DNA, 3490 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000381831
  CDS Start-End: 265-3297
ctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 166060 - DNA, 3469 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000381839
  CDS Start-End: 244-3276
atgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 166061 - DNA, 3571 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000424203
  CDS Start-End: 344-1264
agaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtgggtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgaga

SEQ ID NO: 166062 - DNA, 837 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000426819
  CDS Start-End: 143-837
cgcataagttgtcagtccccagcagtgtttgggagccttaacaggcttgctaagtgcctgagattaaaggcgaagaggaagaagagcaagaagggcaacccggtgtttaacacacggctttcaggcgctctcagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacaggggg

SEQ ID NO: 166063 - DNA, 715 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000441403
  CDS Start-End: 308-715
ttttggcgctcccccccggcgctcctggaaacactgcgtggcaccccgtaccactgtcacattataaacgtgctaaggcttgggtgtctcggctggggagcagtcaggcagcgcccagggcgggagggaatcagactagattctcgccgcggagacccagggccgcgcggaccaatggggcagggaagccgtcgtagggcggggcagtgaggggcggtgccgcgctggtcccgcgccggtcccggtgggccgacttccggcgagcgggcaagcgggaaccaggtggccacccggtgtcgacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttc

SEQ ID NO: 166064 - DNA, 805 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000366093
  CDS Start-End: 1-437
cacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcagattaaaaataggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgca

SEQ ID NO: 166065 - DNA, 1036 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000430874
  CDS Start-End: 314-1036
cccgtccctggcggacaaccgggcctacgagtagctaaacggcaggggggacccaaacaggggagaagggtgaacatcttaactcggttctgaaacagggagtcttgggttacctcggaaaaggcgaagttcctcgagggaaaaggaagggagcggctgggggggcggttggggggggcccggaaaatggatcccaggcccaggcggggccctagcggggcctgagccggggaacgactgcgtctccgaagaaaggtgccaaagaaggctaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcag

SEQ ID NO: 166066 - DNA, 697 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000438059
  CDS Start-End: 282-697
agccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccaacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgag

SEQ ID NO: 166067 - DNA, 1119 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000573055
  CDS Start-End: 1-926
atgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 166068 - DNA, 1119 bp, Homo sapiens; identical to SEQ ID NO: 166067
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000571089
  CDS Start-End: 1-926

SEQ ID NO: 166069 - DNA, 1208 bp, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENST ID: ENST00000574289
  CDS Start-End: 1-672
gctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctatggagtttcactctgttacccaggctggagtggagtagcgcgatctcagcttactgcaacctctgcctcccgggttcaagggattctcctgcttcagcctcctgaatagctgagattataggtgtttaccaccatgcccagctaatttttgtacttttagtagagacggggtttcactatgctggccaggctggtctggaactccccacctcaagcaatctgcccacctcggcctcccaaagtgttgggattataggcatgagccaccgcgcctggcctaaaaaaaaaaaaaaaaatctttttttataaaaaatttgattcatagtttttttaaatacaacgagtacattgaacatgcttcacattcagaacatgaagtcttttaaatgaatataggtagaacttccaacttccaggctttgtaacagaaatcatattaaagactcagtagcaagcctaatcctcaaatcccccatctgttaacctgataatcctcatgtgtaaacttatttaagaagctaactcctgagccacctgtattctgagcattgcaataaagatgtgaagattttaa

SEQ ID NO: 166070 - DNA, 1119 bp, Homo sapiens; identical to SEQ ID NO: 166067
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENST ID: ENST00000575273
  CDS Start-End: 1-926

SEQ ID NO: 166071 - DNA, 6121 bp, Homo sapiens
  Payload ID: 12689
  Gene Symbol: PHKA1
  Gene Name: phosphorylase kinase, alpha 1 (muscle)
  Uniprot ID: P46020
  ENST ID: ENST00000339490
  CDS Start-End: 302-3934
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 166072 - DNA, 4476 bp, Homo sapiens
  Payload ID: 12689
  Gene Symbol: PHKA1
  Gene Name: phosphorylase kinase, alpha 1 (muscle)
  ENST ID: ENST00000373539
  CDS Start-End: 379-4101
gacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtccaatggtggtcatcccctgggtatagatttgatgtcaccgtcttttatgtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaag

SEQ ID NO: 166073 - DNA, 6020 bp, Homo sapiens
  Payload ID: 12689
  Gene Symbol: PHKA1
  Gene Name: phosphorylase kinase, alpha 1 (muscle)
  Uniprot ID: P46020
  ENST ID: ENST00000373542
  CDS Start-End: 161-3832
tccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttca

SEQ ID NO: 166074 - DNA, 6173 bp, Homo sapiens
  Payload ID: 12689
  Gene Symbol: PHKA1
  Gene Name: phosphorylase kinase, alpha 1 (muscle)
  ENST ID: ENST00000373545
  CDS Start-End: 440-3985
tcgcgcccgccccgcctcccgctcgcgtctcccgcaaggtggaggcggcgcagcggtcgttgacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtccaatggtggtcatcccctgggtatagatttgatgtcaccgtcttttatgtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttca

SEQ ID NO: 166075 - DNA, 5944 bp, Homo sapiens
  Payload ID: 12689
  Gene Symbol: PHKA1
  Gene Name: phosphorylase kinase, alpha 1 (muscle)
  Uniprot ID: P46020
  ENST ID: ENST00000541944
  CDS Start-End: 302-3757
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 166076 - DNA, 5559 bp, Homo sapiens
  Payload ID: 12690
  Gene Symbol: PHKA2
  Gene Name: phosphorylase kinase, alpha 2 (liver)
  Uniprot ID: P46019
  ENST ID: ENST00000379942
  CDS Start-End: 667-4374
cggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgct

SEQ ID NO: 166077 - DNA, 5464 bp, Homo sapiens
  Payload ID: 12691
  Gene Symbol: PHKB
  Gene Name: phosphorylase kinase, beta
  Uniprot ID: Q93100
  ENST ID: ENST00000299167
  CDS Start-End: 26-3307
tggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacgtaagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcaccttta

SEQ ID NO: 166078 - DNA, 4283 bp, Homo sapiens
  Payload ID: 12691
  Gene Symbol: PHKB
  Gene Name: phosphorylase kinase, beta
  Uniprot ID: Q93100
  ENST ID: ENST00000323584
  CDS Start-End: 25-3306
ggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggttggcggtgcgctacggggctgcatttacccagaaattttcttcctctatagccccacacattactacttttctggtacatgggaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactcc

SEQ ID NO: 166079 - DNA, 1032 bp, Homo sapiens
  Payload ID: 12691
  Gene Symbol: PHKB
  Gene Name: phosphorylase kinase, beta
  ENST ID: ENST00000566037
  CDS Start-End: 345-1032
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcga

SEQ ID NO: 166080 - DNA, 3829 bp, Homo sapiens
  Payload ID: 12691
  Gene Symbol: PHKB
  Gene Name: phosphorylase kinase, beta
  Uniprot ID: Q93100
  ENST ID: ENST00000566044
  CDS Start-End: 190-3450
cggcattgctgacaggcggccccgggggcggtggccaaggcggcgaccggagcgcgatggcgggggcggcgggactcacggcagaagtgagctggaaggtcttggagcgaagagctcggaccaagcgctcagttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaa

SEQ ID NO: 166081 - DNA, 697 bp, Homo sapiens
  Payload ID: 12691
  Gene Symbol: PHKB
  Gene Name: phosphorylase kinase, beta
  ENST ID: ENST00000563376
  CDS Start-End: 247-697
gatggcgggggcggcgggactcacggcagaagtgagctggaaggtcttggagcgaagagctcggaccaagcgctcagaaattattttcggacgggcgcggtggctcacgcctgtaatcccagcactttgggaggccgaggcgggcggatcacctgaggtcaggagttcgagaccagcctggccaacctgttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacag

SEQ ID NO: 166082 - DNA, 499 bp, Homo sapiens
  Payload ID: 12691
  Gene Symbol: PHKB
  Gene Name: phosphorylase kinase, beta
  ENST ID: ENST00000568439
  CDS Start-End: 1-229
aaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttgttcttgaacagcctggctgaatatcacatcataggaacacagttgcaccggtgccttaggatgctgagagttctgtgaaagtgatctgaaaaattaaacacaaagatgccccatcagtacaaaa

SEQ ID NO: 166083 - DNA, 412 bp, Homo sapiens
  Payload ID: 12691
  Gene Symbol: PHKB
  Gene Name: phosphorylase kinase, beta
  ENST ID: ENST00000567200
  CDS Start-End: 382-412
aaattgcaacgtcatgacttgtggcgttattaaaacttcctgtattcctggttggctggatataatcttgaacaaaaggcatgcacttaaacaggaaaggtgaaaggcggaatgcaggttttcagctaaggagcttcccttttaaagaattgatgaagtgtcattattgggggtgggtgtgaaaggtgttagctaggaaaattaactttgcacttgcattgatattaagaaattattttcggacgggcgcggtggctcacgcctgtaatcccagcactttgggaggccgaggcgggcggatcacctgaggtcaggagttcgagaccagcctggccaacctgcttagcctgcgacgcttatgattagagccaacaatttgaaatggcctgctcacctgatgcagtcgtctctc

SEQ ID NO: 166084 - DNA, 697 bp, Homo sapiens
  Payload ID: 12691
  Gene Symbol: PHKB
  Gene Name: phosphorylase kinase, beta
  ENST ID: ENST00000564711
  CDS Start-End: 1-236
gacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaactgacacagattttacctgtcaactctttacaaacagaagatcgaatgccttgcctactgttttcctttgtaggatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctt

SEQ ID NO: 166085 - DNA, 1375 bp, Homo sapiens
  Payload ID: 12691
  Gene Symbol: PHKB
  Gene Name: phosphorylase kinase, beta
  ENST ID: ENST00000566275
  CDS Start-End: 1-633
tcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtttgcaaaggccgtgtgctctcacaagagaagttcaccttggaggagggggccctttcagccatggttgagtcccctgtaggcccagtggaatgatcccaaagcatctcatatggaaactccatctcagaatcccattgggatgatctcttgccatctaacatgatgtcacctctccgtcacctggtagacactcacgacacctgtggcaaacaccctaaaatcccttcagacctacgcccacagcactcttccaccacagtaataaaggcttgggaatgctgtttctgccctagggatatcagacaacttcagataactgtcatcctgtctgtggggcttgtgatagtgcccctctgaagagtaaaaagatacttttgtgtcttctatgtttttattagacttcatcctcaataaattatactaaggcctcaacccctttaagtgaatgggccccttgcatatttgtttattagcagcagcaaatacatactcagtatgtttctttacaaattttaccttgaattagtccctggaaggtttttagtttgcttaaaattggtgagcaaattattcatttataaagtctttgaatgtcaaatttcctataaattgttgaacatgtaactgtttctgagttagtcctttgtgtattgtagtggttgtagcacaattttaaaagaaagggaggggatttatagaatgtattctttttttactgccttatggtacaataagcacatcagactcattcttacttggctttttgctattgtttctctcttttaaatgttaattatgattaaagagattgattgattggt

SEQ ID NO: 166086 - DNA, 1493 bp, Homo sapiens
  Payload ID: 12691
  Gene Symbol: PHKB
  Gene Name: phosphorylase kinase, beta
  ENST ID: ENST00000564873
  CDS Start-End: 1273-1493
gttctccttacgttttgggcttttcctatttatgaagttcttagttgtctgttgtgcacactgacttttttttttttttttttggagaaagtaaatctaatttctgaaaatctaatttcagaaatcatacaccgaacactctgtttttttataccttacaaaaagttcagctttatatacttagggttatagtaaaattaccatctatgaagtatgagataattttttcaaaaagtagtccttagtactactaagaatcaataaagtgacttggaatagtcacatgtatttgtttcacactttttcttaaattgtttttgtgtgatatagaaatactgagttggctactaacgatgtggctatctggatataaaaagtgttattggattggttatgtctgaacaaagagaataactggagttttcttacagggacctgagtactgcccccaacatatatttttgcaacatttctctttaactttcataagctcatagagttgattttcttcgtcagtctttgtttcctctgaaatgcatgtcataacagtaagctttgaaaaccttaattctcttttcttagctgagaaaaaaaattctagtgttaactgttgttgagtgcagttatttaaatccacttttatgtgcaaagtgcatagtatcaatgttgaatgttcctgtatgtttacatcatagtagtaaagagataccacttgaagttattcctccaaattaatagttaaatttgaggtttcagattcttgtaagtatatgaagtacagaggataaagttaataactcgagttaataacttcctgtatcattaaaagcaatcaacttgattctgtttgttacttttagaagaatatataaatggagctttgttaaacacttgactaacctgactccagtatagagtcctccccacagagttctgagcattgttacatagtagcataattacttcactgcacaacagaggatactacttttatgtaatgtctaataagtggatattatatagtttctatctcatccatatgagcaagtgtaatttatcaaagcaaagaaaatcacattttcaagtcataaaagagaaaataaaattataatgatcctcagttactgcctttgttgcatactgcatcatgttaataactgctcacactgctttcaattaatttaacactgattgcttctaacctttactaaacagttttaaaattgctatagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaa

SEQ ID NO: 166087 - DNA, 797 bp, Homo sapiens
  Payload ID: 12691
  Gene Symbol: PHKB
  Gene Name: phosphorylase kinase, beta
  ENST ID: ENST00000570047
  CDS Start-End: 1-563
tcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgaggatttcctgcacttggtagacaaaagcaacaaattgctgaacaaaaagagatgcagcttctgcctcctccagcctctgttgagttgagaatcagcaggctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagat

SEQ ID NO: 166088 - DNA, 1431 bp, Homo sapiens
  Payload ID: 12692
  Gene Symbol: PHKG1
  Gene Name: phosphorylase kinase, gamma 1 (muscle)
  Uniprot ID: Q16816
  ENST ID: ENST00000297373
  CDS Start-End: 196-1359
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctgatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggt

SEQ ID NO: 166089 - DNA, 580 bp, Homo sapiens
  Payload ID: 12692
  Gene Symbol: PHKG1
  Gene Name: phosphorylase kinase, gamma 1 (muscle)
  ENST ID: ENST00000395428
  CDS Start-End: 152-418
agatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaaca

SEQ ID NO: 166090 - DNA, 483 bp, Homo sapiens
  Payload ID: 12692
  Gene Symbol: PHKG1
  Gene Name: phosphorylase kinase, gamma 1 (muscle)
  ENST ID: ENST00000446428
  CDS Start-End: 132-483
ctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgaggtctcccgattcctggtggtgcaaccccagaaccgctac

SEQ ID NO: 166091 - DNA, 582 bp, Homo sapiens
  Payload ID: 12692
  Gene Symbol: PHKG1
  Gene Name: phosphorylase kinase, gamma 1 (muscle)
  ENST ID: ENST00000432123
  CDS Start-End: 146-582
tatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgct

SEQ ID NO: 166092 - DNA, 2139 bp, Homo sapiens
  Payload ID: 12692
  Gene Symbol: PHKG1
  Gene Name: phosphorylase kinase, gamma 1 (muscle)
  ENST ID: ENST00000537360
  CDS Start-End: 196-1368
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgaccttttccacaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttcccttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctca

SEQ ID NO: 166093 - DNA, 2226 bp, Homo sapiens
  Payload ID: 12692
  Gene Symbol: PHKG1
  Gene Name: phosphorylase kinase, gamma 1 (muscle)
  Uniprot ID: Q16816
  ENST ID: ENST00000452681
  CDS Start-End: 196-1455
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctatgggaagacactgatacaatggagatggaacagaaatggtgcttgggctgggactctcccaagtccaccaacttcagggcccagggcagggcaaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttcccttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctca

SEQ ID NO: 166094 - DNA, 1536 bp, Homo sapiens
  Payload ID: 12693
  Gene Symbol: PHKG2
  Gene Name: phosphorylase kinase, gamma 2 (testis)
  ENST ID: ENST00000328273
  CDS Start-End: 70-1302
cggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgaccttctctttcccagctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgc

SEQ ID NO: 166095 - DNA, 1566 bp, Homo sapiens
  Payload ID: 12693
  Gene Symbol: PHKG2
  Gene Name: phosphorylase kinase, gamma 2 (testis)
  Uniprot ID: P15735
  ENST ID: ENST00000424889
  CDS Start-End: 211-1335
aattgggcggccggtttccaattggaagggcttctgagcctcagtcttcgggcggcgctgaccattggcgggcaggatggaggcggagccttgggttgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactggataaggaagcagtggattggaaagctgatggcttgtgtatgatgatgctactaataatgacatattccaggcagaaatcccctgcttctgcttcccatggtcacttgtgccaggcccggttcctcttctccctggggctcaaacctggtagctgccccctctcaccaatacaagccttgtgaagatcctggagcagggcacaagccgctgacgtctgctccagtgagaagccctgctggcggcagaaaatgagcgcgtggcagaagaggtcca

SEQ ID NO: 166096 - DNA, 726 bp, Homo sapiens
  Payload ID: 12693
  Gene Symbol: PHKG2
  Gene Name: phosphorylase kinase, gamma 2 (testis)
  ENST ID: ENST00000563607
  CDS Start-End: 239-502
cctcctgggcacatctccccactcccctccctgccctgccatcctcccgcccccaggctcttctgcggggtctccccagtccgggtccttcccccacccccccccaccccccaggaccctggcgccccagctgcaagggctgcgcccccgggagccgccatgcgggtcgtctcagagcctgtgggcctccctgccctcactgccctcctcctccgcgcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggagtcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagctt

SEQ ID NO: 166097 - DNA, 908 bp, Homo sapiens
  Payload ID: 12693
  Gene Symbol: PHKG2
  Gene Name: phosphorylase kinase, gamma 2 (testis)
  ENST ID: ENST00000565924
  CDS Start-End: 145-908
agccccaattgggcggccggtttccaattggaagggcttctgagcctcagtcttcgggcggcgctgaccattggcgggcaggatggaggcggagccttgggttgtcgcccgccgccgggggttaaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccc

SEQ ID NO: 166098 - DNA, 5539 bp, Homo sapiens
  Payload ID: 12693
  Gene Symbol: PHKG2
  Gene Name: phosphorylase kinase, gamma 2 (testis)
  Uniprot ID: P15735
  ENST ID: ENST00000563588
  CDS Start-End: 240-1460
agccgagcgccgactcacgccccagccccaattgggcggccggtttccaattggaagggcttctgagcctcagtcttcgggcggcgctgaccattggcgggcaggatggaggcggagccttgggttgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccagggagaacaggtgtcctgtgtctgtctggcttgggcaggaaagcccagaaggtgctcagcagggtgcagggatggtgccattctggcccagacctttattggggaaaatgttgggggtcacttggtcttgctcttgcctttacccggaggtagctggaagggccgctctagtgcagtcaacttgctgctgagcctttcctcgctggccttgagccgctcctccaccagcccctggagctgctccagctctttgttcacttgggtcttgatgtaggctcggaggacgtggatgtggcctgcaggggcagggaagaaggggcagggtgaggagagatgctgtctggcaatggggggatggtccctagttgggcaaacagtccccaaatttcccctggtggggatatagaggtagcaatgttgtttccctttaggaaatgttagcaagcccttgtgtgagaggtagttgggtagggtggctatgctggactttgcagcttcaaattctgatccctactcagtagctgtgtgaccttaggcaggttatttaacctatctgtgcctcagtttccttgtatgaaatgtggatagtgatacctagcacataggattgagggaggattaaatgagttaatttatgtaaaatgcttagagcagggcatgcactgcacacctattgccaagtatgtgctggctgttattgtcattggctttctctttttttttttttttttgagatggagtcttgctttatcccccaggctggagtgcagtggcagcgatctcagctcactgcaagctctgcctcccaggttcatgccattctcctgcctcagcctcccagtagctgggactacaggcacccgccaccacgcccggctaactttttgtatttttagtagagacggggtttcacagtgttagccaggatggactcgatctcctgacctcgtgatccgcctgcctcagcctcccaaagtgctgggattacagttgtgagccactgcacctggcctgttctttgtttttttttaactcttaagttctgggatacgagcagaacatgcaggtttgctacgtaggtatacatgggccatggtggtttgctttacccatcaacccatcatataggttttaagccaccgtcattggctttctaatgatcatttctctggagccacttcagctgtgctttttgtttgtttgtttgtttgttttgagacagagtcttgctctgttgcccaggctggagtgcagtggccagatcttggctcactgcagtctccacctcctgggttcatgcagttctcctgcctcagcctcctgagtagctgggactacaagcgcgcaccaccatgcctggctattttttgtattttagtagatagggggtttcacggtgttgcccaggctggtcgcgaactcctgagctcaggcaatccgcctgcctcagattgtgctgggattacaggtgtgagccaccacgcctggcctgcagctgtgcttttatctgtcatcttggacttctgcataagggatcatttagagaaaggactctgactaaaaacaaaaagtctgaagtcctgatgtcatccaaacccttcattctacacctgctcagagggacagggcagcctgccctctccagatcctcacttggctctggctctggtggggccactgtctctagttcctctttctgcggggtaactgcctgctcctccatctccttgctttcttctttctctgcaaaccagaagcaggaagagactgtggccccaggcctggcccagcccagccctgccctggcactctcccttacccgtctcactctctggccacagtttgggtggctgtagccccatgtaagtcaaagacagatccagccgcacctgggaagcaaggcagagggaggctgaaaggagtgcacctgtgctgaggggaggggcggttgagggtggctcctcatggtccaccaccccctacctggggtgtgaagacgtatttatagagcttgaagtggcggaagtaagtgttgaccacgtagtcttccaaggccagcagctgttcctctttgaagaggtcgatgctgaaaggaggccgctgtggtggtgactcggaattagaaccctgactaccttccggagccctggctttgcctccaaaagcccagcaacaggagcaaggagagcccactggggtcttcacaagaagataagggtgatgaatgtgagagagactgggtgagaccttgtctggggatgggtaaagtttccagaatgttccaggggaactgaccctgactccatggcaaaaaaggacactggtgaagtagcggtagcactcctccacgttgcccaagggggttgctggtagggaaagcaagatgcagcagtgaggccctctctggtatccattcattcacttcactcaacagctgtttatgaccatgagcttcagaagcagacagatctgggtttcagcactggcttgtttccttaactcatgtaacaaatactgaatacccactatatgcccactgtatggttttcggcactgaacaagacagacaaggtcctgcccttacgaagcttatattctaggggaataaaccaagaaatagatcatttcagctattaaacattctgaagcaagagctattaaacattctaaagcaggtgttattgtgcactatgcatatatttgcatatattatttctcagaacagtcctgtaaaatgtgtgctgtatccttaatttctagataaggaagcagtggattggaaagctgatggcttgtgtatgatgatgctactaataatgacatattccaggcagaaatcccctgcttctgcttcccatggtcacttgtgccaggcccggttcctcttctccctggggctcaaacctggtagctgccccctctcaccaatacaagccttgtgaagatcctggagcagggcacaagccgctgacgtctgctccagtgagaagccctgctggcggcagaaaatgagcgcgtggcagaagaggtccagggtgatggcgtccctcaggctctgctcaggacaccctagctccagcagctcagccagcacccttgggagggagagaggagtgagtgacaactgggcctcctttcatcaccctacacccaccacatgctttggagtcagccattcctcatgttttcccaacctgacccctcagcctttgccaagagctcttcccacgcccccctcagtccctactccctcatctcagcattggtggtcttctccagctggtgcatggaatggacgtccaggtacttcctgttatagtaaaagaaaaagagtattggtggccgttacctatcatgacaaggctgtgacagctagtgcgtgagactgggagttggccaccggcgtgaagctgggctcttttgccagcttgctgtgtgactatgcaaatcgttaactctctgggcctaaatgaactcttatgagcctctccatttctaaagcctagggttaggaatcttgaattcttttttctgctctgccactaccttgtatgaccttggtcaagtactccctgtggccctcagtgtccccctctgtacaatactccttagcggccatgagactccatttacattctgtctttggctctttttttctcacactgcctcctctttggactggagaggctggaaagccaacttccagtcacctggagtaattgcatctccaggcctcagtctcatctgtaaaatggggatgccctggccacagacaggactgttggggagacaataaagaacgcaaatattcagtgtaa

SEQ ID NO: 166099 - DNA, 621 bp, Homo sapiens
  Payload ID: 12693
  Gene Symbol: PHKG2
  Gene Name: phosphorylase kinase, gamma 2 (testis)
  ENST ID: ENST00000561712
  CDS Start-End: 1-241
gatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgaggtagacagtgagctcggtaagggctcatctcatttgccacttggcaaatcagtgcaacttggcattcaagaaatacttggtgtaggaatgaatttcccaacaaagtcagtttcaattcggggctgttaaaatctcctggaagtgtgccatggaacaaggttcagaaagtactggaagaattggtgcccgagtggtagaacaaactaaaaatacagacttgagccaagcgtggtggcacgcatctgtcaccccagctactcgggaggctgaaggaggaggctcacttgagcctaggagcccaaggctacaatgagctgtgatagtgccaccacactccagcctgtgtgacatagcgaccctgtctctaaaaataaataaatataaaaataca

SEQ ID NO: 166100 - DNA, 1068 bp, Homo sapiens
  Payload ID: 12693
  Gene Symbol: PHKG2
  Gene Name: phosphorylase kinase, gamma 2 (testis)
  ENST ID: ENST00000565897
  CDS Start-End: 271-1068
acagccgcctgcccttgcgccccttccccctgcctcctgggcacatctccccactcccctccctgccctgccatcctcccgcccccaggctcttctgcggggtctccccagtccgggtccttcccccacccccccccaccccccaggaccctggcgccccagctgcaagggctgcgcccccgggagccgccatgcgggtcgtctcagagcctgtgggcctccctgccctcactgccctcctcctccgcgcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagac

SEQ ID NO: 166101 - DNA, 3048 bp, Homo sapiens
  Payload ID: 12694
  Gene Symbol: PYGL
  Gene Name: phosphorylase, glycogen, liver
  Uniprot ID: P06737
  ENST ID: ENST00000216392
  CDS Start-End: 334-2877
ggaaatccggaagggagcctccgagcccaggtcccgggctggcaggggtctcgccggcgcttggacctcgtctcccacccccgagcccactgcggccccagagcctcgggaggggccgggcacttcctctgccctccggcctggggcaggggccgggacgcggtgggagtgcagcggggacggcaccgcccgagggggcgggccccaaactttcgtgcgcgttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagg

SEQ ID NO: 166102 - DNA, 2711 bp, Homo sapiens
  Payload ID: 12694
  Gene Symbol: PYGL
  Gene Name: phosphorylase, glycogen, liver
  ENST ID: ENST00000532462
  CDS Start-End: 54-2513
ggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagagggtatattacctctctctggaattttacatgggccgaacattacagaacaccatgatcaacctcggtctgcaaaatgcctgtgatgaggccatttaccagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaaatctgatgctgtcaggcccaagcattggccaggaaaggactcagtacagacaggaccactcagagaaacagtaagataagtccacgtatttacaatactctgaaaagcaaattgtccagagaggggaagagaactagctgttctttatcttcattagaacttttgtcctttgatttgtattctctctctccattcagcctctgctatggtctgagtgtttgtgtctgcccaaaattcatatgctgaaagcctaaccccagaggtgatggtattagaa

SEQ ID NO: 166103 - DNA, 2696 bp, Homo sapiens
  Payload ID: 12694
  Gene Symbol: PYGL
  Gene Name: phosphorylase, glycogen, liver
  Uniprot ID: P06737
  ENST ID: ENST00000544180
  CDS Start-End: 81-2522
acccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaaggaccgcaacgtggccaccacccgcgactactacttcgcgctggcgcacacggtgcgcgaccacctggtggggcgctggatccgcacgcagcagcactactacgacaagtgccccaagcttggattggatatagaagagttagaagaaattgaagaagatgctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtggtcctggctctgccatatgacacccccgtgcccggctacatgaataacactgtcaacaccatgcgcctctggtctgctcgggcaccaaatgactttaacctcagagactttaatgttggagactacattcaggctgtgctggaccgaaacctggccgagaacatctcccgggtcctctatcccaatgacaatttttttgaagggaaggagctaagattgaagcaggaatactttgtggtggctgcaaccttgcaagatatcatccgccgtttcaaagcctccaagtttggctccacccgtggtgcaggaactgtgtttgatgccttcccggatcaggtggccatccagctgaatgacactcaccctgcactcgcgatccctgagctgatgaggatttttgtggatattgaaaaactgccctggtccaaggcatgggagctcacccagaagaccttcgcctacaccaaccacacagtgctcccggaagccctggagcgctggcccgtggacctggtggagaagctgctccctcgacatttggaaatcatttatgagataaatcagaagcatttagatagaattgtggccttgtttcctaaagatgtggaccgtctgagaaggatgtctctgatagaagaggaaggaagcaaaaggatcaacatggcccatctctgcattgtcggttcccatgctgtgaatggcgtggctaaaatccactcagacatcgtgaagactaaagtattcaaggacttcagtgagctagaacctgacaagtttcagaataaaaccaatgggatcactccaaggcgctggctcctactctgcaacccaggacttgcagagctcatagcagagaaaattggagaagactatgtgaaagacctgagccagctgacgaagctccacagcttcctgggtgatgatgtcttcctccgggaactcgccaaggtgaagcaggagaataagctgaagttttctcagttcctggagacggagtacaaagtgaagatcaacccatcctccatgtttgatgtccaggtgaagaggatacatgagtacaagcgacagctcttgaactgtctgcatgtgatcacgatgtacaaccgcattaagaaagaccctaagaagttattcgtgccaaggacagttatcattggtggtaaagctgccccaggatatcacatggccaaaatgatcataaagctgatcacttcagtggcagatgtggtgaacaatgaccctatggttggaagcaagttgaaagtcatcttcttggagaactacagagtatctcttgctgaaaaagtcattccagccacagatctgtcagagcagatttccactgcaggcaccgaagcctcggggacaggcaatatgaagttcatgctaaatggggccctaactatcgggaccatggatggggccaatgtggaaatggcagaagaagctggggaagagaacctgttcatctttggcatgaggatagatgatgtggctgctttggacaagaaagggtacgaggcaaaagaatactatgaggcacttccagagctgaagctggtcattgatcaaattgacaatggctttttttctcccaagcagcctgacctcttcaaagatatcatcaacatgctattttatcatgacaggtttaaagtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaacaaagtcaatggaaattgaactctagaattgtctctagaaaacatagcttcttactgaacttgaacatttttacaacattcactggtttttgttttgttagctaataatctataatagttgagtatctctgggaatggggagggaaattatatgtaatagagcttaaaaataaagtgtcaatttccaagggct

SEQ ID NO: 166104 - DNA, 3198 bp, Homo sapiens
  Payload ID: 12695
  Gene Symbol: PYGM
  Gene Name: phosphorylase, glycogen, muscle
  Uniprot ID: P11217
  ENST ID: ENST00000164139
  CDS Start-End: 400-2928
ccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccagctgggcctggacatggaggagctggaggaaattgaggaggatgcggggctgggcaacgggggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 166105 - DNA, 2611 bp, Homo sapiens
  Payload ID: 12695
  Gene Symbol: PYGM
  Gene Name: phosphorylase, glycogen, muscle
  Uniprot ID: P11217
  ENST ID: ENST00000377432
  CDS Start-End: 77-2341
actccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 166106 - DNA, 4134 bp, Homo sapiens
  Payload ID: 12696
  Gene Symbol: PYGB
  Gene Name: phosphorylase, glycogen
  brain
  Uniprot ID: P11216
  ENST ID: ENST00000216962
  CDS Start-End: 111-2642
cgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctgaca

SEQ ID NO: 166107 - DNA, 734 bp, Homo sapiens
  Payload ID: 12696
  Gene Symbol: PYGB
  Gene Name: phosphorylase, glycogen
  brain
  ENST ID: ENST00000428458
  CDS Start-End: 1-734
tgaaacatcaccacacagtaccaccatccgtcacacctaaagcattggacaggagtcctccgtgtcctgaaatgttcactcgggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctgg

SEQ ID NO: 166108 - DNA, 4288 bp, Homo sapiens
  Payload ID: 12697
  Gene Symbol: PHAX
  Gene Name: phosphorylated adaptor for RNA export
  Uniprot ID: Q9H814
  ENST ID: ENST00000297540
  CDS Start-End: 696-1880
gctggcgagtgtaccctttctgcagaaagtaaaaatggccttattcagtaagttaaatttatgttgctatttctttacgacaccggaaaacaaacatttcaaacaccatgctgagaactcagtccttgttttggggagggatgcacttggaagattcgagctaaggtacaatcctccctaggtatccgcgggtcattgttttcaggacccccacagataccaacatccgccatgctcaagccccttacattatgtgggggtgcacggtgggtccttcccatccgcaggttcggcatccgtggatggggagtggatacagagggcggactatacagcttgaaaggcttccctggaagcaatatgtagagtggattgtggaggagcaagaacagaagcggggaggcttgtccagagcatacaggggaaggatgtacggccaagggaggaatcccagacgaccgcgatacgtgacatatttatgtttgcacgaaaataaagtttggaagaaaagtgttgggggaacaagggattcattttcccggggtagttggaatgcaatgggacgcctcaggccgctgggacaggctggcctccgcgcgggggcgcccgagcagccgagccgccgggccttccggctgccccgccggaagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcagaagtttgagaccagccaggccaacatggtgaaacttcatctctactaaaaatacaaaaactagccaggtgtggttctccatgcctataatcccggctactcgggaggctgaggcaggagaatcacctgaacccgggaggcaaaggttgcagtgagctgagatcgtaccactgtactccagcctgggcgacagagcaagactctgtctcaaaaaaaaaaaaaaatacaattaagaggtgtatactgatgattcttcccactcatttgtttgtccagaagtaaataaatgtcggaagttttccaagtaactatttgttttttggggggttttttagttagagtcttgatctgtcacccaggctggagtacagtggcaggatctcagcttactgcagcttccatctcccaggttcaagcgatcatgtgcctaagcctcctgagtagctgggatcacaggtgtgtaccaccacgcccagctgatttttgtatttttagtaaagactttcgccatgttgtccaggctggtctcgaactcctggcctaatgatctgcccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgcctgtagtcccaactactagggaggctgaggcaggagaatcacttgaacccaggaggtggaggttgcagtgagccgagatcacgccactgcactccagcctggcgacagagcgagactccctctcaaaaaaaaaaaaaaaaatacaaaaaattagccgggcattgtggtgcatgcctgtaatctcagctatttgggaggccgaggcaggagaatcacttgaacccaggaggcagaggttgcagtgagtcgagatcgtgccactgcactccagcctgggtgacagagcaagactttgtctcaaaaataataatagtaaaatgttacatgtgcatgaagttttaaattactcatttttattaatgaagaaaataaggtagtttagacattccaagagttaactatagtttacaaaaatatattaagcaaaaatatgcttgatatattaagcagaaatgttgtatattaagcaaaaatgtaaaattcagcaattataaactgttccttacagacagtgtacttgaagtcttttggtagttctgagaatgtggtcattgaagttggatctaagaggaaagtggttatcggttgctttttatttataaaggatgcaaaaataaaattagatttttggcagtccttaa

SEQ ID NO: 166109 - DNA, 1411 bp, Homo sapiens
  Payload ID: 12698
  Gene Symbol: PSAT1
  Gene Name: phosphoserine aminotransferase 1
  Uniprot ID: Q9Y617
  ENST ID: ENST00000347159
  CDS Start-End: 69-1043
ggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggta

SEQ ID NO: 166110 - DNA, 2188 bp, Homo sapiens
  Payload ID: 12698
  Gene Symbol: PSAT1
  Gene Name: phosphoserine aminotransferase 1
  Uniprot ID: Q9Y617
  ENST ID: ENST00000376588
  CDS Start-End: 69-1181
ggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaa

SEQ ID NO: 166111 - DNA, 2131 bp, Homo sapiens
  Payload ID: 12699
  Gene Symbol: PSPH
  Gene Name: phosphoserine phosphatase
  Uniprot ID: P78330
  ENST ID: ENST00000275605
  CDS Start-End: 759-1436
gttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtca

SEQ ID NO: 166112 - DNA, 2178 bp, Homo sapiens
  Payload ID: 12699
  Gene Symbol: PSPH
  Gene Name: phosphoserine phosphatase
  Uniprot ID: P78330
  ENST ID: ENST00000395471
  CDS Start-End: 807-1484
gttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtc

SEQ ID NO: 166113 - DNA, 555 bp, Homo sapiens
  Payload ID: 12699
  Gene Symbol: PSPH
  Gene Name: phosphoserine phosphatase
  ENST ID: ENST00000424596
  CDS Start-End: 524-555
tcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggggaaggaacagaagagtgtcgtctcctagaaatctagcactggagaaacgaggaaaattcttccagcgatggtctcccactcagagctgaggaagctttt

SEQ ID NO: 166114 - DNA, 633 bp, Homo sapiens
  Payload ID: 12699
  Gene Symbol: PSPH
  Gene Name: phosphoserine phosphatase
  ENST ID: ENST00000421312
  CDS Start-End: 494-633
gatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaat

SEQ ID NO: 166115 - DNA, 826 bp, Homo sapiens
  Payload ID: 12699
  Gene Symbol: PSPH
  Gene Name: phosphoserine phosphatase
  ENST ID: ENST00000421626
  CDS Start-End: 265-826
agtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtc

SEQ ID NO: 166116 - DNA, 744 bp, Homo sapiens
  Payload ID: 12699
  Gene Symbol: PSPH
  Gene Name: phosphoserine phosphatase
  ENST ID: ENST00000419984
  CDS Start-End: 605-744
aagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggacagagtctcgttctgtcgcccaggctggagtgcagtggtgtgatctcggctcacttcaacctccgcctacagggttcaagggattctcctgcctcagcctcctgagtatctgggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaat

SEQ ID NO: 166117 - DNA, 1409 bp, Homo sapiens
  Payload ID: 12699
  Gene Symbol: PSPH
  Gene Name: phosphoserine phosphatase
  Uniprot ID: P78330
  ENST ID: ENST00000437355
  CDS Start-End: 331-1008
tttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaaggaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaa

SEQ ID NO: 166118 - DNA, 809 bp, Homo sapiens
  Payload ID: 12699
  Gene Symbol: PSPH
  Gene Name: phosphoserine phosphatase
  ENST ID: ENST00000427797
  CDS Start-End: 358-630
cagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatacccggggcagtaaggcatgttaaccttgaggacatcggacctggctggcctgactgttgggtctccctcctaggacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatccca

SEQ ID NO: 166119 - DNA, 539 bp, Homo sapiens
  Payload ID: 12699
  Gene Symbol: PSPH
  Gene Name: phosphoserine phosphatase
  ENST ID: ENST00000413218
  CDS Start-End: 533-539
acacgcgagtctgataagcaccctcccccggaatcatgcggtgctgtgaggcctagcgaagatgaagatagaatgcaagagtctcactctatcgcccaggctggagtgcaatggtgccatctcagctcactgcaacctccccttcccaagttcaagcaattttcatgccgcagcctcctagctgggattacagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtct

SEQ ID NO: 166120 - DNA, 739 bp, Homo sapiens
  Payload ID: 12699
  Gene Symbol: PSPH
  Gene Name: phosphoserine phosphatase
  ENST ID: ENST00000416592
  CDS Start-End: 733-739
gatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggacagagtctcgttctgtcgcccaggctggagtgcagtggtgtgatctcggctcacttcaacctccgcctacagggttcaagggattctcctgcctcagcctcctgagtatctgggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtct

SEQ ID NO: 166121 - DNA, 1705 bp, Homo sapiens
  Payload ID: 12700
  Gene Symbol: PSTK
  Gene Name: phosphoseryl-tRNA kinase
  Uniprot ID: Q8IV42
  ENST ID: ENST00000368887
  CDS Start-End: 441-1487
ggtggtcggactgtcagcctcgccttctattctttgatttccagtaacttattttcgaaagattgctggagggaaaggctcaacgtctcttttgggattttcctaagcagaaagacctcatcctaacaaaactgaggcgccaatcctactggctggcaactttcggcagggagggtgattctatttgaagatcaatcctaactctgggaccccttgggaatgtccaggagctaggaacgcagcgccgcggtctctccagcctctggtccctgggagcaagcagggcaccggtggagcaggtgcctctggggccgcacggaaacccagctaggccagttcctccactgcgccggtaggcggcggagacgctgcgcgtgcgcgcagggcagacggtagagcggagacgacgctcccagactcctccggtctccccgggcagcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaaggtaatcaggaagccttctcagagatgacatttaagcaaagatgggtaagagcgaaccatgcagctatctggaggatcattctaggcaatgaacacatcaagtgcagaagcgcaaaggttggctggttgcagtgttgcagaatcgagaagaggccattgagcacggggtgagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaa

SEQ ID NO: 166122 - DNA, 1098 bp, Homo sapiens
  Payload ID: 12700
  Gene Symbol: PSTK
  Gene Name: phosphoseryl-tRNA kinase
  ENST ID: ENST00000406217
  CDS Start-End: 1-1079
gcatgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaagatgaacaagtgcttcctcacaacttgaagcttctagcagaagaacttaacaagctcaaagcagagtttttggaagacctaaaacaaggaaacaaaaaatatctgtgctttcagcaaaccattgacataccagatgtcatttctttttttcattatgagaaagataatattgtacagaagtatttttcaaagcagcattaaaatttctgaactgccaatc

SEQ ID NO: 166123 - DNA, 1047 bp, Homo sapiens
  Payload ID: 12700
  Gene Symbol: PSTK
  Gene Name: phosphoseryl-tRNA kinase
  Uniprot ID: Q8IV42
  ENST ID: ENST00000405485
  CDS Start-End: 1-1047
atgaagaccgccgagaacatcagaggaaccggcagcgacgggccgcggaaacgaggcctctgcgtcctctgtggcctccccgcggcaggaaaatcgactttcgcgcgcgccctcgcccaccggctgcagcaggagcagggttgggccatcggtgttgtcgcgtatgatgacgtcatgcccgacgcgtttctcgccggggcaagagcgcgaccggcgccatcccaatggaaattgcttcgacaggaactgttgaagtacctggaatacttcttgatggctgtcattaatgggtgtcagatgtctgtcccacccaacaggactgaagccatgtgggaagattttataacctgcttaaaggatcaagatctgatattttctgcagcatttgaggcccagtcttgctacctcttaacaaaaactgctgtttctagacctttgtttttggttttggatgacaatttttattatcagagtatgagatatgaagtctaccagctggctcggaaatattcgttgggcttttgccagctctttttagattgtcctcttgagacctgtttacagaggaatggccagaggccacaggcactgcctcctgagaccatccacctgatgggaagaaagctagaaaagcccaaccctgagaaaaatgcttgggaacacaacagcctcacaattccgagtccagcatgtgcttcggaggccagcctggaagtgactgatttattgctcactgctttggaaaatccagtaaaatatgctgaggacaatatggaacaaaaggacacagacagaattatttgttcaactaacattcttcataaaactgatcagacactccgaaggattgtatctcagacaatgaaggaagcaaaaggtaatcaggaagccttctcagagatgacatttaagcaaagatgggtaagagcgaaccatgcagctatctggaggatcattctaggcaatgaacacatcaagtgcagaagcgcaaaggttggctggttgcagtgttgcagaatcgagaagaggccattgagcacggggtga

SEQ ID NO: 166124 - DNA, 3448 bp, Homo sapiens
  Payload ID: 12701
  Gene Symbol: PTER
  Gene Name: phosphotriesterase related
  Uniprot ID: Q96BW5
  ENST ID: ENST00000298942
  CDS Start-End: 51-959
agaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggatagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaa

SEQ ID NO: 166125 - DNA, 3777 bp, Homo sapiens
  Payload ID: 12701
  Gene Symbol: PTER
  Gene Name: phosphotriesterase related
  Uniprot ID: Q96BW5
  ENST ID: ENST00000378000
  CDS Start-End: 247-1296
aaaaaggccagggaagttggcctgccggaagttcccagggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttc

SEQ ID NO: 166126 - DNA, 3212 bp, Homo sapiens
  Payload ID: 12701
  Gene Symbol: PTER
  Gene Name: phosphotriesterase related
  ENST ID: ENST00000423462
  CDS Start-End: 121-723
gagagaaccagagggcgaagtgggagggcacaggggagactaaaaaggccagggaagttggcctgccggaagttcccagggagaaggcagcgcgttgtacccgagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaa

SEQ ID NO: 166127 - DNA, 1203 bp, Homo sapiens
  Payload ID: 12701
  Gene Symbol: PTER
  Gene Name: phosphotriesterase related
  Uniprot ID: Q96BW5
  ENST ID: ENST00000535784
  CDS Start-End: 154-1203
gagagaaccagagggcgaagtgggagggcacaggggagactaaaaaggccagggaagttggcctgccggaagttcccagggagaaggcagcgcgttgtacccgagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaatag

SEQ ID NO: 166128 - DNA, 839 bp, Homo sapiens
  Payload ID: 12702
  Gene Symbol: PID1
  Gene Name: phosphotyrosine interaction domain containing 1
  Uniprot ID: Q7Z2X4
  ENST ID: ENST00000354069
  CDS Start-End: 32-784
atgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaata

SEQ ID NO: 166129 - DNA, 2745 bp, Homo sapiens
  Payload ID: 12702
  Gene Symbol: PID1
  Gene Name: phosphotyrosine interaction domain containing 1
  Uniprot ID: Q7Z2X4
  ENST ID: ENST00000392054
  CDS Start-End: 341-1087
aggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcat

SEQ ID NO: 166130 - DNA, 2533 bp, Homo sapiens
  Payload ID: 12702
  Gene Symbol: PID1
  Gene Name: phosphotyrosine interaction domain containing 1
  Uniprot ID: Q7Z2X4
  ENST ID: ENST00000392055
  CDS Start-End: 243-896
agtcctctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcatt

SEQ ID NO: 166131 - DNA, 2387 bp, Homo sapiens
  Payload ID: 12702
  Gene Symbol: PID1
  Gene Name: phosphotyrosine interaction domain containing 1
  Uniprot ID: Q7Z2X4
  ENST ID: ENST00000409462
  CDS Start-End: 238-744
tctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaa

SEQ ID NO: 166132 - DNA, 553 bp, Homo sapiens
  Payload ID: 12702
  Gene Symbol: PID1
  Gene Name: phosphotyrosine interaction domain containing 1
  ENST ID: ENST00000534952
  CDS Start-End: 197-322
acaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggatggctgctgcaactccagtcacaatacacttgtccctcagtatccctggggaatcgattcaggacctcttgtgaataccaaaatctacagatagtcaagaccgtgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattg

SEQ ID NO: 166133 - DNA, 1577 bp, Homo sapiens
  Payload ID: 12703
  Gene Symbol: PHYH
  Gene Name: phytanoyl-CoA 2-hydroxylase
  Uniprot ID: O14832
  ENST ID: ENST00000263038
  CDS Start-End: 60-1076
gcccgctgggctaaatggggcagaggccgggaggggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcgg

SEQ ID NO: 166134 - DNA, 1732 bp, Homo sapiens
  Payload ID: 12703
  Gene Symbol: PHYH
  Gene Name: phytanoyl-CoA 2-hydroxylase
  Uniprot ID: O14832
  ENST ID: ENST00000396913
  CDS Start-End: 511-1227
cggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaaccggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggacaa

SEQ ID NO: 166135 - DNA, 1829 bp, Homo sapiens
  Payload ID: 12703
  Gene Symbol: PHYH
  Gene Name: phytanoyl-CoA 2-hydroxylase
  ENST ID: ENST00000396920
  CDS Start-End: 406-1371
cttgcgttcaaaccgtgacaaaccgtagagtccttgagagccccgggttactcctacatggtcatattcccgcgcgggatgccgaagtggggcagatgaggtccggagctgctgagggatcccgggtccttctgttggtctgagaccctggggcgggcggaatcccggagaaagccggagggactccccagtggaagcctgggagctgccgttctcctccctgcctgtgcaaacaggaaggggctggtgatgctggctgcgggcctccctcctggactgcgacattgtcaccaaattctataaagacgtcatgcaggaagtgataacgtgtgctgcgacgttctggaagtaactcgaagctaaaaaagaacaaaaaatcaatgaaaaaatgaaactaaagaaacaatgagatgctatgtcaatatccctcatcccacttcagggactatttcctctgccagtttccatcctcaacaattccagtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcatagg

SEQ ID NO: 166136 - DNA, 883 bp, Homo sapiens
  Payload ID: 12703
  Gene Symbol: PHYH
  Gene Name: phytanoyl-CoA 2-hydroxylase
  ENST ID: ENST00000453759
  CDS Start-End: 356-883
ccggaggggagaggacggtgccctcccgggcaggagctggccaggcaggcgctgcccagggcggcctccctgctggactacggcattgccactgagttatataaagacactatttggggaaggacagcgggtagctcatcccacttcagggactatttcctctgccagtttccatcctcaacaattccagtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaag

SEQ ID NO: 166137 - DNA, 642 bp, Homo sapiens
  Payload ID: 12703
  Gene Symbol: PHYH
  Gene Name: phytanoyl-CoA 2-hydroxylase
  ENST ID: ENST00000479604
  CDS Start-End: 11-642
cgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgcaagaagacgtcccgtcaccccctgcaccaggacctgcactatttccccttcaggcccagcgatctcatcgtttgcgcctggacggcgatggagcacatcagccggaacaacggctgtctggttgtgct

SEQ ID NO: 166138 - DNA, 3099 bp, Homo sapiens
  Payload ID: 12704
  Gene Symbol: PHYHIP
  Gene Name: phytanoyl-CoA 2-hydroxylase interacting protein
  Uniprot ID: Q92561
  ENST ID: ENST00000321613
  CDS Start-End: 458-1450
ttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagccatgtaccgcggcaacgcttgctgaccccagtgaggagagaggcctgaatccgagggccctggcacctgtgagctcttggctgtcacctgccccaagcctcgcacctccgctccacagcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcagtcc

SEQ ID NO: 166139 - DNA, 3200 bp, Homo sapiens
  Payload ID: 12704
  Gene Symbol: PHYHIP
  Gene Name: phytanoyl-CoA 2-hydroxylase interacting protein
  Uniprot ID: Q92561
  ENST ID: ENST00000454243
  CDS Start-End: 576-1568
agagatttccaagtagggggtgtgttggagggacttctgagggcagcttgtcctggaagaatgggggaaaggcggcgtgtgttgctgtccctgaggacatctgtgtagctccctgggagaccctctgccctttccccctcccaccagcccggcgagcagggaccaagcctgcttattatcacctgacgctgcgcagccgctgatcccattggtggaggcagattcggtctggctctctcgttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggc

SEQ ID NO: 166140 - DNA, 769 bp, Homo sapiens
  Payload ID: 12704
  Gene Symbol: PHYHIP
  Gene Name: phytanoyl-CoA 2-hydroxylase interacting protein
  ENST ID: ENST00000523252
  CDS Start-End: 26-769
gccatttgcttgacttagaaaaggaatgggagagagtcctccgtgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctg

SEQ ID NO: 166141 - DNA, 3569 bp, Homo sapiens
  Payload ID: 12705
  Gene Symbol: PHYHIPL
  Gene Name: phytanoyl-CoA 2-hydroxylase interacting protein-like
  Uniprot ID: Q96FC7
  ENST ID: ENST00000373878
  CDS Start-End: 334-1386
gacgaggcgtttccgatctttgccgcagtccggatttcctgggtctctgggcactgaaggggaaatgccctcgggatgtttctagcaacccccttcccccaacacacacacactagttggcattctcttccagaaacttatcattttcttttttaaacctcccatcctcagactccccaaattaacaagtctttttagcctcttggattgggattaggatgacagtttttcagtgagggcgcagaaaaacagtgcatttcagcaccaaggacagacacaatcttcatggttcctgggctctgagtcagactgtcgaaaatattggcctaatatatgtgctgtgattcagactttgtggcgaggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctgtgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaaggacattattctgattcataaaagttataaaatattaggtaaatacagagaaaacaataagcctctgaaataagtctgtttctgaaatagtcaatagtcttcccatccaaactataagagaatgtgaatttcttcaacatcatacttaaacattacagaaaatagaaatacaaacaaggttggtacatgagagaaaatgttgaccttttacttccttttacaaaaatgaaaataataaacatgttttcgtataaaataacacaaaatgatatacactgaagttgatgaagcaaataaatattctggcttctttttcaaggtatcagggcaaacaatttccaaacttttcattttgtacagaaggatgaataactacagctcatgggaaatgttttgactttacaaagtatagatgttggaacattaagaaaaatgtatattcccaatgaaaaaatagttatatcatcttatagtaaaccaaaagattagcaataatactatggacacattagattatatactacagacacatatctatccaaaatacctattttaaatttttaatacaatattttattttaatataaacatctgtcagttatagacaaagataataattcacaaagtacatgctatcagaatgaactttggtaaccagaaatgtaaaatttcaaataacggataaaataatgtgttatttttatagagaaagaaaaaaatagcaacacaatctagtttattttagggtactgagagcctagcagacttaaaggacaaggtagtaaatgttttatcactcaaaaatccattagaagtttcaaataaattgctttcttgctagctgtattccttcctacttgaaaagcgaatttcttttcctcctatgattgattttttaaaatcatgctcttttccatacatcaacataaacagtctttggatactaaataaactttccctaacaagtgtcctagctatgttatttagatttgataaaatattagacatttttaaaaatacttgtattgactatgagttttctgcttggcatggaggacactgaattttttcccaattatatggctacctgttgtattcttccccccgtttaaatcccttctccttgtatataattaaacttgctattccttcttaaaaacagctaatactaccactaaagtgcttccattttcattgtgtcaaaactacttagcaaggatggcagaggaaaataaactttactttatatcatgggtgaaagtgatcataacatttcctgaacctcaaatagttttggccacatcttgcttgctgatgaggacctctaatagtctcagtttggcttttatgtgcttatattcataatactcatctgccattggtatcctatcttccttttgtggacttctgcaaaacaaaaatacatttgttagttcacaatgaa

SEQ ID NO: 166142 - DNA, 3578 bp, Homo sapiens
  Payload ID: 12705
  Gene Symbol: PHYHIPL
  Gene Name: phytanoyl-CoA 2-hydroxylase interacting protein-like
  Uniprot ID: Q96FC7
  ENST ID: ENST00000373880
  CDS Start-End: 265-1395
cccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctgtgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaaggacattattctgattcataaaagttataaaatattaggtaaatacagagaaaacaataagcctctgaaataagtctgtttctgaaatagtcaatagtcttcccatccaaactataagagaatgtgaatttcttcaacatcatacttaaacattacagaaaatagaaatacaaacaaggttggtacatgagagaaaatgttgaccttttacttccttttacaaaaatgaaaataataaacatgttttcgtataaaataacacaaaatgatatacactgaagttgatgaagcaaataaatattctggcttctttttcaaggtatcagggcaaacaatttccaaacttttcattttgtacagaaggatgaataactacagctcatgggaaatgttttgactttacaaagtatagatgttggaacattaagaaaaatgtatattcccaatgaaaaaatagttatatcatcttatagtaaaccaaaagattagcaataatactatggacacattagattatatactacagacacatatctatccaaaatacctattttaaatttttaatacaatattttattttaatataaacatctgtcagttatagacaaagataataattcacaaagtacatgctatcagaatgaactttggtaaccagaaatgtaaaatttcaaataacggataaaataatgtgttatttttatagagaaagaaaaaaatagcaacacaatctagtttattttagggtactgagagcctagcagacttaaaggacaaggtagtaaatgttttatcactcaaaaatccattagaagtttcaaataaattgctttcttgctagctgtattccttcctacttgaaaagcgaatttcttttcctcctatgattgattttttaaaatcatgctcttttccatacatcaacataaacagtctttggatactaaataaactttccctaacaagtgtcctagctatgttatttagatttgataaaatattagacatttttaaaaatacttgtattgactatgagttttctgcttggcatggaggacactgaattttttcccaattatatggctacctgttgtattcttccccccgtttaaatcccttctccttgtatataattaaacttgctattccttcttaaaaacagctaatactaccactaaagtgcttccattttcattgtgtcaaaactacttagcaaggatggcagaggaaaataaactttactttatatcatgggtgaaagtgatcataacatttcctgaacctcaaatagttttggccacatcttgcttgctgatgaggacctctaatagtctcagtttggcttttatgtgcttatattcataatactcatctgccattggtatcctatcttccttttgtggacttctgcaaaacaaaaatacatttgttagttcacaatgaa

SEQ ID NO: 166143 - DNA, 1971 bp, Homo sapiens
  Payload ID: 12705
  Gene Symbol: PHYHIPL
  Gene Name: phytanoyl-CoA 2-hydroxylase interacting protein-like
  Uniprot ID: Q96FC7
  ENST ID: ENST00000486074
  CDS Start-End: 194-343
gagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgttgtttttgaagaacttacatccaaacagacaagaaaaggataaaagcaccattggttcatggcaagttattacattttaagtgattaactggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctgtgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaata

SEQ ID NO: 166144 - DNA, 1599 bp, Homo sapiens
  Payload ID: 12706
  Gene Symbol: PHYHD1
  Gene Name: phytanoyl-CoA dioxygenase domain containing 1
  Uniprot ID: Q5SRE7
  ENST ID: ENST00000308941
  CDS Start-End: 421-1314
cctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgca

SEQ ID NO: 166145 - DNA, 1374 bp, Homo sapiens
  Payload ID: 12706
  Gene Symbol: PHYHD1
  Gene Name: phytanoyl-CoA dioxygenase domain containing 1
  Uniprot ID: Q5SRE7
  ENST ID: ENST00000353176
  CDS Start-End: 237-1049
cggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgca

SEQ ID NO: 166146 - DNA, 2133 bp, Homo sapiens
  Payload ID: 12706
  Gene Symbol: PHYHD1
  Gene Name: phytanoyl-CoA dioxygenase domain containing 1
  Uniprot ID: Q5SRE7
  ENST ID: ENST00000372592
  CDS Start-End: 934-1809
agcaaacacgacttgactcgaggccaaggctcttgagggctgagcagtgtccccatgcacactcctgaaacactttgtcccttcgccattcagaaggcatcattttggggaaggcagcagccggtttttcagagccagcgagtggccctgccagctgctgagcagggcaagctgagaagggtggtggtgtgcaagtgttattctctctttttgtttttgtttttgttttttgagatggagtcttactctgtcgtccaggctggagtgagtgccgtggcatgatctcggctcactgcaacctccgcctcctgggttcaagcgattctcctgcctcagcctcccgagtaactgggactacaggcacctgccaccatgctcggctagtttttggtatttttatttattatttatttatttattttgagaccgagtctcgctctgtcgcccaggctctagtgcagtggcccaatctcggctcactgcaagctccgcctcccgcgttcacgccattctcctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 166147 - DNA, 548 bp, Homo sapiens
  Payload ID: 12706
  Gene Symbol: PHYHD1
  Gene Name: phytanoyl-CoA dioxygenase domain containing 1
  ENST ID: ENST00000419552
  CDS Start-End: 350-548
cctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagca

SEQ ID NO: 166148 - DNA, 753 bp, Homo sapiens
  Payload ID: 12706
  Gene Symbol: PHYHD1
  Gene Name: phytanoyl-CoA dioxygenase domain containing 1
  ENST ID: ENST00000419872
  CDS Start-End: 1-294
tcttgcagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagggccctggtcctcatccatggagaagtggtacacaagagcaagcagaacctctctgaccgctcgcgccaggcctacactttccacctcatggaggcctctggcaccacctggagcccggagaactggtaggtgacagggtgggtgtgtgtgcccgacagtcccctggaggctgggaacagtgaccctgcacctcaaggttgtttctcctctatcctctgcaggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgca

SEQ ID NO: 166149 - DNA, 790 bp, Homo sapiens
  Payload ID: 12706
  Gene Symbol: PHYHD1
  Gene Name: phytanoyl-CoA dioxygenase domain containing 1
  ENST ID: ENST00000428610
  CDS Start-End: 599-790
actttgtcccttcgccattcagaaggcatcattttggggaaggcagcagccggtttttcagagccagcgagtggccctgccagctgctgagcagggcaagctgagaagggtggtggtgtgcaagtgttattctctctttttgtttttgtttttgttttttgagatggagtcttactctgtcgtccaggctggagtgagtgccgtggcatgatctcggctcactgcaacctccgcctcctgggttcaagcgattctcctgcctcagcctcccgagtaactgggactacaggcacctgccaccatgctcggctagtttttgtagagacggggtttcaccgtgttagccaggatggtctcgatttcctgacctcgtgatccgcgcgcctctgcctccaaagtgctgggattacaggcccgagccgccgcacccggcctgcagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccag

SEQ ID NO: 166150 - DNA, 1811 bp, Homo sapiens
  Payload ID: 12706
  Gene Symbol: PHYHD1
  Gene Name: phytanoyl-CoA dioxygenase domain containing 1
  ENST ID: ENST00000412476
  CDS Start-End: 446-928
actgcaacctccgcctcctgggttcaagcgattctcctgcctcagcctcccgagtaactgggactacaggcacctgccaccatgctcggctagtttttgtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaaggtgagctgagagctgtgggcccctgaaaaggccatgggtgggacatctaagacagcaatggttctcagatcttcagaaggagggaaagcgcttgctcctgtctgttgtaggagcctggcccggagaggaggagccaccttccattccttcccctgatagtggattgtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 166151 - DNA, 780 bp, Homo sapiens
  Payload ID: 12706
  Gene Symbol: PHYHD1
  Gene Name: phytanoyl-CoA dioxygenase domain containing 1
  ENST ID: ENST00000442837
  CDS Start-End: 1-495
cctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgca

SEQ ID NO: 166152 - DNA, 1182 bp, Homo sapiens
  Payload ID: 12706
  Gene Symbol: PHYHD1
  Gene Name: phytanoyl-CoA dioxygenase domain containing 1
  Uniprot ID: Q5SRE7
  ENST ID: ENST00000421063
  CDS Start-End: 42-854
gaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcagct

SEQ ID NO: 166153 - DNA, 615 bp, Homo sapiens
  Payload ID: 12706
  Gene Symbol: PHYHD1
  Gene Name: phytanoyl-CoA dioxygenase domain containing 1
  ENST ID: ENST00000451000
  CDS Start-End: 11-151
gagcgtctccatggcctgcctgagcccctcgcagctccagaagcagccaatattgattgctctttgctgggtgccagactccatgcctggggttggggacagggcagcaaacaagatacctggtcccaccttcacacagctgcaaggttgagggaagggtcagacaggagcatttgcagactggggaagcctgagtctcaagcctgcctgcagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaag

SEQ ID NO: 166154 - DNA, 872 bp, Homo sapiens
  Payload ID: 12706
  Gene Symbol: PHYHD1
  Gene Name: phytanoyl-CoA dioxygenase domain containing 1
  ENST ID: ENST00000426694
  CDS Start-End: 342-872
ctgcagatggatgcgttaattcccttccataatcctcccaggaccgagagggtttcagatcggtgctgggaggggcccagatagttctccccaggacctcttccacctttggaatgcccattacctggagaaggggggtgccgcacatcccccagaccaaccctgcatcccattctatccagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtg

SEQ ID NO: 166155 - DNA, 711 bp, Homo sapiens
  Payload ID: 12706
  Gene Symbol: PHYHD1
  Gene Name: phytanoyl-CoA dioxygenase domain containing 1
  ENST ID: ENST00000424503
  CDS Start-End: 1-163
ggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccaggcccagctctgaccccaggatgctgtctcagtcctctgatgtcccctttccacagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgc

SEQ ID NO: 166156 - DNA, 20329 bp, Homo sapiens
  Payload ID: 12707
  Gene Symbol: PCLO
  Gene Name: piccolo presynaptic cytomatrix protein
  Uniprot ID: Q9Y6V0
  ENST ID: ENST00000333891
  CDS Start-End: 339-15767
gcggtgcgcggtgggaggggcggacggcgcccggctggcaccgctcagatctgcttctccccggctcggggcgccgaggcggcgtccgggaggtgtcttctgcaaaggttgcctggcgctgtccaacatggaggaggcaccggcagcgggcgttacctgcgagcgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagccatgggcaacgaggcgagcttggaaggggaagggctccccgaagggctggcggcggccgcagcggctggaggaggagctagcggggcggggagcccctctcacaccgcgatcccggccggcatggaggcggatttgagccagctgagcgaagaggagaggagacagatcgccgctgtcatgtcaagggcgcaggggctgcccaagggaagcgtccccccggccgctgcggagtcgccttccatgcacaggaaacaagagttggatagtagtcatcctccaaagcaatcaggaagacccccggaccctgggcgtccagctcaacctggtctcagtaaaagtagaactacagacactttcaggtcagagcagaaattgcctgggaggagtccttccactattagcttgaaagaatcaaagtccagaactgatttaaaggaagagcacaagtctagtatgatgcctggcttcctctcagaggttaacgctttaagtgctgtttcctctgttgtaaataaattcaacccttttgatttgatatcagactctgaggcatcccaggaagaaaccaccaagaaacaaaaagtggttcagaaggagcaaggaaaacctgaaggaatcataaaacctcctttacaacaacagccacccaagccgattcctaagcagcaaggacctggtagggatccgcttcagcaggatggcactcccaaatcaatatcttctcaacaaccagaaaaaattaaatcacaacctccaggtacaggaaagccaattcagggtcctacccagactcctcagacagaccatgcaaaattgccacttcaacgagatgcatccaggcctcagactaaacaggcagacatagtaaggggagaatcagttaaaccctcactgccaagcccatccaaaccacctattcagcaaccaactcctggaaaacctccagcacagcagcctggacatgaaaaatcacagcctgggcctgcaaagcccccagctcagccctcagggctaacaaagccattggctcaacaaccagggacagtgaaacccccagtccagccaccagggacaacaaagcctccagctcagcctcttggtcctgctaagcctccagctcagcagactgggtcagagaagccttcatcggagcagcctgggccaaaggctttagctcagcctcctggagttggaaagactccagctcaacagccagggccagcaaagcctccaacccagcaggtggggacaccaaaacccctagctcaacaacctgggctacagtctccagctaaggcacctgggcctacaaagactccagttcagcagcctgggccaggaaagattccagctcaacaggcaggacccggaaagacttctgcccagcagactggcccaacaaagcctccttcacaactgcctggcccagcaaagcccccacctcaacagcctggcccagcaaagcccccacctcaacagcctggctcagcaaagcccccatctcaacagcctggctcaacaaaacccccacctcaacagcctggcccagcaaagccctcacctcaacagcctggctcaacaaaacccccatctcaacagcctggctcagcaaaaccctcagctcaacagcctagcccagcaaagccctcggctcagcaatctacaaaaccagtaagccaaacaggatctggaaaacctctgcagccaccaacagtgtctccatctgcaaaacagcctccttcacaaggcctccctaaaaccatctgtcctctttgcaataccactgaacttctgttgcatgttccagaaaaggccaattttaacacatgcactgagtgtcaaaccactgtctgtagtctctgtggttttaatcccaatcctcatttaacggaggtaaaagagtggctctgtttgaactgtcaaatgaaaagagctctaggcggggatctggctccagttccgtcatcaccccagcccaaactgaagactgcacctgttaccactacatcagcagtgagcaaatcatccccacagccacagcagacttccccaaagaaggatgctgcaccaaaacaggatctctccaaggcacctgagcctaaaaagccaccaccactagtgaaacaaccaacccttcatggctctccttcagccaaggccaagcagccccctgaggcagattctttgtccaagccagcccctcccaaagaaccttctgtcccatctgagcaggacaaggcccctgttgctgatgataaaccaaagcagcccaagatggtaaagccaaccactgaccttgtatcttcatcatcagcaacaacaaaacctgatattccaagctccaaagtacagtcacaagctgaagagaaaacaacccctcctctaaaaacagactctgccaaaccctcacagagttttccaccaacaggggaaaaagtcagcccatttgattctaaagccatacctcgacctgcatcagattcaaaaattatttcacatcctggtcccagttcagagagcaaaggtcaaaaacaagttgaccccgtacaaaagaaggaagaacccaagaaagcacaaaccaaaatgagtcctaaaccagatgccaagccaatgccaaaagggtcaccaacaccccctggcccacgacctaccgctggccaaactgtccccacacctcaacagtccccaaagcctcaggagcagtcaaggcgtttcagtctgaatctgggaagtattactgatgcccccaaatcacagcctacaactcctcaagagaccgtgactgggaaactctttgggtttggagcatcaatcttcagccaggcatcaaatttaatttccactgcaggccaacctggacctcattcacaaagtggaccaggggccccaatgaaacaagcccctgccccttcacagccacctacttcacaagggccacccaaatccacaggtcaagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaaaactgaactcaacataggttctaaggatcctcctaacttcaatacttgcactgaatgcaagaatcaagtgtgtaatctctgtggatttaaccctacaccacatttgactgagattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactggagaaaattaagcaacagcgctttgctgaggaattggagtgggaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaacaaagcctcccaatcaccggcctgcagaaagctctgtgtccaccggctcctcgggcagcagctttggcagtgggtatagcgtggacagtgaaggaagcagcagcactgcaggggagactaatctatttcctattccgaggatagggaagatgggacagaatggacaagagcctgtaaaacagccaggggtaggagtaggactagcagacactgaagctaaaactcaggtaatgggagaaatcaagattgcattgaagaaggaaatgaagacagatggtgaacaactaatagttgaaattctccaatgcagaaatattacatacaaatttaagtctcctgatcatctaccagatttatatgtgaaaatatatgtgatgaatatttctacccaaaaaaaggtgatcaagaaaaaaacaagagtatgcagacatgatcgagagccttcgtttaatgaaacttttcgattcagtctaagtcctgcaggacattctcttcagattttacttttctccaatggagggaagtttatgaaaaagaccttgattggtgaagcctgtatctggcttgacaaagtggatctcagaaaaagaatagtcaactggcacaaacttttggtcagtcctactcaaacgcattgaagaaacatgtcttctcagggtatagaaactgctctaaatagcctcacatcaagactatagttgaatactattgtacaaagctaagttttgagaggcaaacataagagtgggaacaacaagcaaaaacatacttaagaccttgtacatttattgttgtggatcacacaaagatattcaactgaaaaagttcacatactgaaaacaagaagaatggagttctgagaccttgaatttcccatggctgtgaagagaaactgtgaaacaaattttgattacttaagacaataatctttgagtagagttgagctatagcttaagacaggctcaaagattaatgtggttttcatgcagcacaaaggtaattctttatgcaaaggagccttggttgaaaggaaaggactgatgtaacaaatctcagttttcaaaacttcaaaaatcttccttcatcgtcttctattcagacaacttgctgctttcagattctgacataagatatacctacagtatgtgtccagggctggaagtgaggtggctgtgttcttagggaaaatggaagaggagatgtagaaattgtggctttcaggccatattttaccagttttctctgtgtctaaatgttacaagcatatacaacactgactttggaatccatgtggtaaaagcacatttgtttctgtatcatttgaaacaaggtagagtgaagataatactcagtagaaataaaattgaatttatctagaaataaaactatgactggctaacaaagaagaatgttgccccataaaatattggaattttggttgaaaccatcaaaatcttcataatttaccattaagccaagacatcttcagtctatgtaccaaaggacctagagtaaactgatatgttctaggaagcatgataacttactctttgtgaaactgcaaataaatgtattatcctgcacatttcctttctgttgagcgatgcattgacagagaaagaaaattctttctctggcaaacaaaccatattaatcttgtgacattgattaattaaatggatcctcatttcataatattttatgcttttttccttaatgacttaattcatttactgattgtatcatgaaaacatgacactaaactcgagttctctctagtgctctattttcttactttagtgacagtatcacagtgatcaagttcatcaatgttgggaaaatatgtgaaaagtcaacatttacctgagattaaaatatactttgagctattttaataataatgaataaaacaactaatgtccaagtcttaaaatgaagcaccctcttctctatcagcattattaattaaggaagtaacgtgaagttgtggaaaaaacactcagcagggaataaaagcctgtcttctggtcttagttctaccactgactgtgtcactttgcacatgtcacttacactcactttaccccagttttcttatctataggataaaaacaattatatattcttaaccttccaaatgagatgttgtgatgataaatcaatgatccatgaaagatgaaagcacatttccaaatatagttttatacacagaagtgaggaataattattacatatctttttaattctcaaattttatatgtgaaaaacatcatctaaaccaatggcaaggattgacatggataaaagcagtaaattagccacaaaacttattttttatttaaaatataaactttaacctgactaaaggtgaagaattacatgaaaatgcaaattttgctatcccaaattaaatgaataatgctggtcttaccctagtcctatattccacccaaaagaaataaatcaaattgcttctcagagcattctgagcttaaaacctgctgctttatttaagggtgaagtgttagtggaattagagaaaaccaactctagatattggttggatattgaattttctcatttttaaagaaaaaatgctctaaatttgagaggactgtaaagcactaaaaataagagaatttctaatatatcccaggatatatatatatatatatgacttcagaatacaaattcgatcttccccaaactgagaaagataaccataacttttcttccctctattttttaatccccctccactgacaatacaatgtcatttaccattgacattgctctcaaatgagcatgggagagtggaatcatcaaagacattatattgctagtattttatttttagaaactattagatctgctgatggttgccatggatatttccagcagaagctagcacttgaagaagcctataatcatcactcataattggggaagaaaaggtccaaggagatctccttctgacataaaaaggctctggtatttgcccttaaaagaaaaccctgactcatctctgatcctcttttgcagccactcatatccataggtatgcatgagagtttgtatgaccagttagctttcttcattccagttgcaatttcttttagaataatataaatggagggatcaccaaaacaaagattatctctttggtagctatttaacctgaaagcgtaggagtctttccattatagaagcccctccgttccaaggaactagcgatggggctaggtcaatcagcagagttgacaacagggcttctttttgtgcaccagcattccccttcagagagcataagatcctgccagtgtgccaagtttgcagctgaccaaacttctaggttgtactggaattattctatgcaacactgatccttatatgaatgcgtttcttctgaatgatgttgactacccttcttacaacaaaactgtttcttttttattgcaaatagggctcttggtgttttttacttttttgtacatatcacagtacatggtttttcactctttagtttatttcattttattggaattaacttttttttattctaatactgacagagtttgtaatctctatataatacgtaattactccaattacagcacttttaccttgaagagcatctcagtttttcccacaatttcattgagtcatcagagactgatgttgcttcttggtttcaaatttggtcctaaagaaactttcggctgtagaaacaaaagcacagagtgaattttttacaaaagacagggaatatagaatagtcattacagacacaaataaccctagtagcacgaagttggtgttttctctgtttttacttaagattaagaagatttttggtgactctgaactctttatttatatttcagtttaaaatatcaagactaaggggcatcagttatctttactctttaatattgcccatattttaataaattacactaattaaacgcatattttcagcataccagtggaattaattttgtggatcacacacatttaaatagtcatattgtgggaatattatagctggtaaccagctgatattgattcttattataggaatgactgtaatgatagtggtggtagcagtagtgatattagcggtggtggtgatgtgaagtaaaataaaagtatatattatattgtgcccaatttattagaaattatttgatcaatgcttcatttcattaaaatatcataaagatgtttatagtatttttttactttattatttaaatcataactaacaatatttttaaaaacttattttcattgctacaatgtcaaatattccaaaatcagccaactacagctatatatgtgttatgtgtgacagaagtgatcttccttccctctttttgagcttgacatgaaagtgaaagaagactcaatgaataattatgagctatttatttaataattacttgccttgggtgtaatacagtaatgaatgagtgaaacaaatattctcattgaatatgatacaatgctgttttctgtatgtttcatgttctattattaaaggtatccattaggccaaaattatttaatcaaattctttatctgataggtagattgagagcattttcttaatgcattaccttgtacataagtatacacttggtaaagtagacgaagttgaaatattaatttcatttggcatttagcatgtgaatatgattattgtttgattgtgtctgtatatttgtttggtgacgtgctcaggtgctcccactactgattaatgtgtgtgctaatatcctaaaaacacatatgaggtttaagaaaaaattttcttgtctgaaaacataaacatcttaataaaactgattttgaaataaaaactaaagtacttgaagatatgtcttgtttctaactatatgttgcatgccatgttggtgatttgctaatgtgtttttttgtttgtttgttttacccaaatccctttggaaaatctaatggacaaatgcaaattcttggactaaggactgtataaattgacctgaaaatacatgagagttgcatttaaaaaaaaatgcttgtaaatccgtcttgagttttactctatgtaaaaatatgtcttggttttgtgattgtatacaagatgtatcttgataacttatgtaaactgtgccgtataaaggctgttgcctcagccttactaataaatactgaaaatatc

SEQ ID NO: 166157 - DNA, 17147 bp, Homo sapiens
  Payload ID: 12707
  Gene Symbol: PCLO
  Gene Name: piccolo presynaptic cytomatrix protein
  Uniprot ID: Q9Y6V0
  ENST ID: ENST00000423517
  CDS Start-End: 339-15146
gcggtgcgcggtgggaggggcggacggcgcccggctggcaccgctcagatctgcttctccccggctcggggcgccgaggcggcgtccgggaggtgtcttctgcaaaggttgcctggcgctgtccaacatggaggaggcaccggcagcgggcgttacctgcgagcgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagccatgggcaacgaggcgagcttggaaggggaagggctccccgaagggctggcggcggccgcagcggctggaggaggagctagcggggcggggagcccctctcacaccgcgatcccggccggcatggaggcggatttgagccagctgagcgaagaggagaggagacagatcgccgctgtcatgtcaagggcgcaggggctgcccaagggaagcgtccccccggccgctgcggagtcgccttccatgcacaggaaacaagagttggatagtagtcatcctccaaagcaatcaggaagacccccggaccctgggcgtccagctcaacctggtctcagtaaaagtagaactacagacactttcaggtcagagcagaaattgcctgggaggagtccttccactattagcttgaaagaatcaaagtccagaactgatttaaaggaagagcacaagtctagtatgatgcctggcttcctctcagaggttaacgctttaagtgctgtttcctctgttgtaaataaattcaacccttttgatttgatatcagactctgaggcatcccaggaagaaaccaccaagaaacaaaaagtggttcagaaggagcaaggaaaacctgaaggaatcataaaacctcctttacaacaacagccacccaagccgattcctaagcagcaaggacctggtagggatccgcttcagcaggatggcactcccaaatcaatatcttctcaacaaccagaaaaaattaaatcacaacctccaggtacaggaaagccaattcagggtcctacccagactcctcagacagaccatgcaaaattgccacttcaacgagatgcatccaggcctcagactaaacaggcagacatagtaaggggagaatcagttaaaccctcactgccaagcccatccaaaccacctattcagcaaccaactcctggaaaacctccagcacagcagcctggacatgaaaaatcacagcctgggcctgcaaagcccccagctcagccctcagggctaacaaagccattggctcaacaaccagggacagtgaaacccccagtccagccaccagggacaacaaagcctccagctcagcctcttggtcctgctaagcctccagctcagcagactgggtcagagaagccttcatcggagcagcctgggccaaaggctttagctcagcctcctggagttggaaagactccagctcaacagccagggccagcaaagcctccaacccagcaggtggggacaccaaaacccctagctcaacaacctgggctacagtctccagctaaggcacctgggcctacaaagactccagttcagcagcctgggccaggaaagattccagctcaacaggcaggacccggaaagacttctgcccagcagactggcccaacaaagcctccttcacaactgcctggcccagcaaagcccccacctcaacagcctggcccagcaaagcccccacctcaacagcctggctcagcaaagcccccatctcaacagcctggctcaacaaaacccccacctcaacagcctggcccagcaaagccctcacctcaacagcctggctcaacaaaacccccatctcaacagcctggctcagcaaaaccctcagctcaacagcctagcccagcaaagccctcggctcagcaatctacaaaaccagtaagccaaacaggatctggaaaacctctgcagccaccaacagtgtctccatctgcaaaacagcctccttcacaaggcctccctaaaaccatctgtcctctttgcaataccactgaacttctgttgcatgttccagaaaaggccaattttaacacatgcactgagtgtcaaaccactgtctgtagtctctgtggttttaatcccaatcctcatttaacggaggtaaaagagtggctctgtttgaactgtcaaatgaaaagagctctaggcggggatctggctccagttccgtcatcaccccagcccaaactgaagactgcacctgttaccactacatcagcagtgagcaaatcatccccacagccacagcagacttccccaaagaaggatgctgcaccaaaacaggatctctccaaggcacctgagcctaaaaagccaccaccactagtgaaacaaccaacccttcatggctctccttcagccaaggccaagcagccccctgaggcagattctttgtccaagccagcccctcccaaagaaccttctgtcccatctgagcaggacaaggcccctgttgctgatgataaaccaaagcagcccaagatggtaaagccaaccactgaccttgtatcttcatcatcagcaacaacaaaacctgatattccaagctccaaagtacagtcacaagctgaagagaaaacaacccctcctctaaaaacagactctgccaaaccctcacagagttttccaccaacaggggaaaaagtcagcccatttgattctaaagccatacctcgacctgcatcagattcaaaaattatttcacatcctggtcccagttcagagagcaaaggtcaaaaacaagttgaccccgtacaaaagaaggaagaacccaagaaagcacaaaccaaaatgagtcctaaaccagatgccaagccaatgccaaaagggtcaccaacaccccctggcccacgacctaccgctggccaaactgtccccacacctcaacagtccccaaagcctcaggagcagtcaaggcgtttcagtctgaatctgggaagtattactgatgcccccaaatcacagcctacaactcctcaagagaccgtgactgggaaactctttgggtttggagcatcaatcttcagccaggcatcaaatttaatttccactgcaggccaacctggacctcattcacaaagtggaccaggggccccaatgaaacaagcccctgccccttcacagccacctacttcacaagggccacccaaatccacaggtcaagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaaaactgaactcaacataggttctaaggatcctcctaacttcaatacttgcactgaatgcaagaatcaagtgtgtaatctctgtggatttaaccctacaccacatttgactgagattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactggagaaaattaagcaacagcgctttgctgaggaattggagtgggaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttataccaaaaaaaaaaaagtgcacacatataagtatttagagcagatttgcaattagattcttgtatctgaaaacactcaaaaagtctaggcagaagataatgcaaccaacagtcaacttctagaaccttggaggaaaagccatttcaagacagtgctttaaaacactaacaaattttgcttctgaaatatggtagctttccatgtgcaaaaaattgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccctagtcatcattttcaaagaaacagccagttttaaacccctttagtgctgtgcatgtggtgtcattttggcatttgaaaacacaacctatttaaatagagcaaaagagcacttctgtttgcatgaataacatttaagctggttccatctgaggatacatactctgggtttccatttcacccacactgccacagcagcacataaaagcggtcagtctaatcatgccaggaagcagcacagacacagcatagcaggagtcctccccattcaaagaactcagtctgataatctgcctccaccagccaatggcaaccaagaccaaagccagctagccctcaggaaggtgatgtctgatggaccagtcaagccagaaggaggtgagcagaaaggccctgttcaaagcacacagcaagaacatccccaaatttaaagctctcatctttaatttttagagattgtctgataaaatatgtttatccactttttaatgtgcttttgtgggcatggcatttcaggacttcatcatcaccatgtaagtcccaagatcagtcccgtaatatattgactacagtgatttgtatttttctatgcactgggcatcttttgacttttgttgggaaatagattaacaatattcatattgcagaatggaatgcatgctactaacctaatctgttcaagcatgactataaatatgtttcattgtgataaaagtttaaattgctcacagttcaagttagcctaccagttggaatgtggatcagtgttttttgcctattatttcaagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcataaa

SEQ ID NO: 166158 - DNA, 3786 bp, Homo sapiens
  Payload ID: 12707
  Gene Symbol: PCLO
  Gene Name: piccolo presynaptic cytomatrix protein
  ENST ID: ENST00000437081
  CDS Start-End: 2-3655
gatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaaggtaaattgggcctcaaactaccctgttactctcaaaactcaaactcttatttttctgcatgtttaatttcccttctccagagatgtatcctacttttcttggtgtgtcttttgcatgtttacttcaattttatttcttgtaaatggaaattttatcatgtgtatagattctgtagcatgcttttctttatttagttttactttattcctttattgttctgtttcttgattgtttgcttgatttgtttggtgtctgcttttctaaaaccattatcaaataattctgtcaataaaatatggtcatcctataaatccatagttgaaaa

SEQ ID NO: 166159 - DNA, 451 bp, Homo sapiens
  Payload ID: 12707
  Gene Symbol: PCLO
  Gene Name: piccolo presynaptic cytomatrix protein
  ENST ID: ENST00000456006
  CDS Start-End: 1-182
gtaatggattaggaattagaattgtgggtggtaaagaaatcccgggacatagtggagaaattggagcctatattgccaagattcttcctgggggaagtgcggaacagacggggaagcttatggaagatggcatggcagtgatcaaggttggagatcaagaaacacagcacacagatgagtgagcttccttgttcttgttccagggggattaccagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaag

SEQ ID NO: 166160 - DNA, 748 bp, Homo sapiens
  Payload ID: 12707
  Gene Symbol: PCLO
  Gene Name: piccolo presynaptic cytomatrix protein
  ENST ID: ENST00000413807
  CDS Start-End: 1-140
gtaatggattaggaattagaattgtgggtggtaaagaaatcccgggacatagtggagaaattggagcctatattgccaagattcttcctgggggaagtgcggaacagacggggaagcttatggaagcctgggattgttgaaataaacctaaggcccatctgaagataaagtttccttggaggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagagg

SEQ ID NO: 166161 - DNA, 1614 bp, Homo sapiens
  Payload ID: 12707
  Gene Symbol: PCLO
  Gene Name: piccolo presynaptic cytomatrix protein
  Uniprot ID: Q9Y6V0
  ENST ID: ENST00000618073
  CDS Start-End: 175-1245
gtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttatacc

SEQ ID NO: 166162 - DNA, 8072 bp, Homo sapiens
  Payload ID: 12708
  Gene Symbol: PIEZO1
  Gene Name: piezo-type mechanosensitive ion channel component 1
  Uniprot ID: Q92508
  ENST ID: ENST00000301015
  CDS Start-End: 248-7813
cgtccggcccagctcggccccagtgagccgagcgctgcgctccgccgaggggcagggcggtcgcctgagcgagcgcgggcccgggacgtcggcaccggcggggcggccgaaggagaaggaggaagaggagaaggcggcgcgcgggtccccgcgggtcagccatggcgcgccggccccggggcccccgcaccgccccatagcgccgcggcgtccgctcggtctgggccgggccctgggccctccagccatggagccgcacgtgctcggcgcggtcctgtactggctgctgctgccctgcgcgctgctggctgcctgcctgctccgcttcagcggactctcgctggtctacctgctcttcctgctgctgctgccctggttccccggccccacccgatgcggcctccaaggtcacacaggccgcctcctgcgggcattgctgggcctcagcctgctcttcctggtggcccatctcgccctccagatctgcctgcatattgtgccccgcctggaccagctcctgggacccagctgcagccgctgggagaccctctcgcgacacataggggtcacaaggctggacctgaaggacatccccaacgccatccggctggtggcccctgacctgggcatcttggtggtctcctctgtctgcctcggcatctgcgggcgccttgcaaggaacacccggcagagcccacatccacgggagctggatgatgatgagagggatgtggatgccagcccgacggcagggctgcaggaagcagcaacgctggcccctacacggaggtcacggctggccgctcgtttccgagtcacggcccactggctgctggtggcggctgggcgggtcctggccgtaacactgcttgcactggcaggcatcgcccacccctcggccctctccagtgtctacctgctgctcttcctggccctctgcacctggtgggcctgccactttcccatcagcactcggggcttcagcagactctgcgtcgcggtggggtgcttcggcgccggccatctcatctgcctctactgctaccagatgcccttggcacaggctctgctcccgcctgccggcatctgggctagggtgctgggtctcaaggacttcgtgggtcccaccaactgctccagcccccacgcgctggtcctcaacaccggcctggactggcctgtgtatgccagccccggcgtcctcctgctgctgtgctacgccacggcctctctgcgcaagctccgcgcgtaccgcccctccggccagaggaaggaggcggcaaaggggtatgaggctcgggagctggagctagcagagctggaccagtggccccaggaacgggagtctgaccagcacgtggtgcccacagcacccgacaccgaggctgataactgcatcgtgcacgagctgaccggccagagctccgtcctgcggcggcctgtgcggcccaagcgggctgagcccagggaggcgtctccgctccacagcctgggccacctcatcatggaccagagctatgtgtgcgcgctcattgccatgatggtatggagcatcacctaccacagctggctgaccttcgtactgctgctctgggcctgcctcatctggacggtgcgcagccgccaccaactggccatgctgtgctcgccctgcatcctgctgtatgggatgacgctgtgctgcctacgctacgtgtgggccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcccacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtgtccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggaggactccagggacgaggggctgggcgtggccactccccaccaggccacgcaggtgcctgaaggggcagccaagtggggcctggtggctgagcggctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgactttcaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctcgctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagccagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccctaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatgga

SEQ ID NO: 166163 - DNA, 1246 bp, Homo sapiens
  Payload ID: 12708
  Gene Symbol: PIEZO1
  Gene Name: piezo-type mechanosensitive ion channel component 1
  ENST ID: ENST00000327397
  CDS Start-End: 1-1122
atgaagatttgcccgttttcttctaaaagttctatagttttagctctgaagtttcgctctttgatccactttgagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccctaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgt

SEQ ID NO: 166164 - DNA, 1635 bp, Homo sapiens
  Payload ID: 12708
  Gene Symbol: PIEZO1
  Gene Name: piezo-type mechanosensitive ion channel component 1
  ENST ID: ENST00000419505
  CDS Start-End: 1-267
taccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggttcatgaagatttgcccgttttcttctaaaagttctatagttttagctctgaagtttcgctctttgatccactttgagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccctaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaa

SEQ ID NO: 166165 - DNA, 544 bp, Homo sapiens
  Payload ID: 12708
  Gene Symbol: PIEZO1
  Gene Name: piezo-type mechanosensitive ion channel component 1
  ENST ID: ENST00000474606
  CDS Start-End: 1-544
ttagccattactacctgcacgtcagggccgacctccaggccaccgccctgctagcctccaggggcttcgccctctacaacgctgccaacctcaagagcattgactttcaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgct

SEQ ID NO: 166166 - DNA, 584 bp, Homo sapiens
  Payload ID: 12708
  Gene Symbol: PIEZO1
  Gene Name: piezo-type mechanosensitive ion channel component 1
  ENST ID: ENST00000466823
  CDS Start-End: 1-554
cgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagatacattggctagaaatgactgaattggaagaattctctgtattctctggttgctagaaccttatcaattaaaatttgcagaaaatt

SEQ ID NO: 166167 - DNA, 660 bp, Homo sapiens
  Payload ID: 12708
  Gene Symbol: PIEZO1
  Gene Name: piezo-type mechanosensitive ion channel component 1
  ENST ID: ENST00000518793
  CDS Start-End: 1-106
ggtcatccctaatctcttccccaagtacatccgtgcccccaacgggcccgaagccaaccctgtgaagcagctgcagcccaatgaggaggccgactacctcggctgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaa

SEQ ID NO: 166168 - DNA, 9356 bp, Homo sapiens
  Payload ID: 12709
  Gene Symbol: PIEZO2
  Gene Name: piezo-type mechanosensitive ion channel component 2
  Uniprot ID: Q9H5I5
  ENST ID: ENST00000302079
  CDS Start-End: 1-8070
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtcattttaa

SEQ ID NO: 166169 - DNA, 9718 bp, Homo sapiens
  Payload ID: 12709
  Gene Symbol: PIEZO2
  Gene Name: piezo-type mechanosensitive ion channel component 2
  ENST ID: ENST00000383408
  CDS Start-End: 328-8439
gccccgggagcgtgccctcggggcggagagcgtcgcggcccgcgccgaggcgatgctcgggtggctgcgagctgccggcggcgagaggccatagacgggcatgggccttgcgtcccaccacccctagggaccctcgagcctcgcccctctgctccgactcgccggaccgacgcgatggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggcaagggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtc

SEQ ID NO: 166170 - DNA, 8259 bp, Homo sapiens
  Payload ID: 12709
  Gene Symbol: PIEZO2
  Gene Name: piezo-type mechanosensitive ion channel component 2
  Uniprot ID: Q9H5I5
  ENST ID: ENST00000503781
  CDS Start-End: 1-8259
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattga

SEQ ID NO: 166171 - DNA, 2671 bp, Homo sapiens
  Payload ID: 12709
  Gene Symbol: PIEZO2
  Gene Name: piezo-type mechanosensitive ion channel component 2
  Uniprot ID: Q9H5I5
  ENST ID: ENST00000538948
  CDS Start-End: 141-2270
atgttaacaattaatcagttcaagttggtcatcttcctagataacctggaccgtaatcttcctagataacctggacatcaggattggtgatggggctgaggggccagtgagtgtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctc

SEQ ID NO: 166172 - DNA, 8465 bp, Homo sapiens
  Payload ID: 12709
  Gene Symbol: PIEZO2
  Gene Name: piezo-type mechanosensitive ion channel component 2
  ENST ID: ENST00000582913
  CDS Start-End: 1-4422
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagccatgccaaagtcaatggtcgcgtatatctaataataaatagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaaggtggctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagctgctacactgaagcaaccatgctgttctcaaggcagtccacccttgatgatttagatggacaagaaattcctaaaacaagcgagcgtgctcggcctaggctccgtaaaatgctcagcatggatatgtcctcctcatcagctgacagtggcagtttagcatcaagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattga

SEQ ID NO: 166173 - DNA, 389 bp, Homo sapiens
  Payload ID: 12709
  Gene Symbol: PIEZO2
  Gene Name: piezo-type mechanosensitive ion channel component 2
  ENST ID: ENST00000582937
  CDS Start-End: 1-279
tggtggtcttcaatgacaaagtcagtcccccaagtctggggttcctggctggctatggcttttaggctgcatgtgagaccatgtccagatgttcatccagacccacagcatggcagaggccttgttgttcactggcagtctccatcagaccttccgtcccaggatgttctttggaggatcttcaaaggcaaccttcctgtggctgcttctccgtgtttgcagtttgaaaatggactagaaccactagcacaagacagcggttatcttgcatgtccatagcaaagatattagtatcttaaatgtttaaattattatcctttacaatgttgccttttctaagtttgtattatttatacttctaacaccattacagtttaaacctgcagtaa

SEQ ID NO: 166174 - DNA, 1021 bp, Homo sapiens
  Payload ID: 12709
  Gene Symbol: PIEZO2
  Gene Name: piezo-type mechanosensitive ion channel component 2
  ENST ID: ENST00000583325
  CDS Start-End: 444-1021
caaccacggaccagcacctcaaggaagaccacctgttgcagctgatttcctgcccaggtggaagttgttagaaaggttgggttcatcttcctcaggacttgcgtggtgcttctggcacccaacacaaacatgggagcatcctcggaaaagggacttaaaagcagtgaatctcagctgaagtcaagcagatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctgggga

SEQ ID NO: 166175 - DNA, 8334 bp, Homo sapiens
  Payload ID: 12709
  Gene Symbol: PIEZO2
  Gene Name: piezo-type mechanosensitive ion channel component 2
  Uniprot ID: Q9H5I5
  ENST ID: ENST00000580640
  CDS Start-End: 1-8334
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagccatgccaaagtcaatggtcgcgtatatctaataataaatagcatcaagaaaaaattaccaatccaccaaaatgaactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattga

SEQ ID NO: 166176 - DNA, 532 bp, Homo sapiens
  Payload ID: 12709
  Gene Symbol: PIEZO2
  Gene Name: piezo-type mechanosensitive ion channel component 2
  ENST ID: ENST00000579112
  CDS Start-End: 1-532
cactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaaggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagag

SEQ ID NO: 166177 - DNA, 3682 bp, Homo sapiens
  Payload ID: 12709
  Gene Symbol: PIEZO2
  Gene Name: piezo-type mechanosensitive ion channel component 2
  ENST ID: ENST00000579949
  CDS Start-End: 1-460
tataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccagtaggttttctcgatccccttacaacctcatcgactctaacccttatatccttgaccagaattcaggcgttcccgtgacccatgtgttccatgcatggtttgatccttgtgacttgatagggggtcggagtgtaggaaaattttaatgtcagtgggtctttgagcccggggtccaattcttccagagacatcagcacagacgttctgacattcttgtgctggctgtagaaagccaaacacgtggcttatagactctagggcataatttatgggctcagaaagggaagaagaattgaatattatattgcccaattctgaggtcgagagccctattcacatacatattttatggctaaatacccttactaaaaatgagcttgggctccaccttggactctgatttaaggatgatcattctattcaaagggtcagtgaccctttctctgtaaggcactaggcatggatgccagtgagcctcccctcccctcattcccacagctttgattttatttgcatttaaggatttttggcaatttattaaatagaaagatgagggataacttaaaatgcactcactttcttactacgcctcctccccaatttcaaaaaggcactctaaattccaatgcccacatgtggcacagccttcaagccacctgatgctcagagacgaccaatgaacagcaaaaaccagaaaactatttttaaaagcagatcctgatagccacatagaatgcagtgtgtttccctcctgatcataaagatgaatgaggaattctggaactcagtggctatatttgctctgcttagcaaagaaaatatcactataggtcgatgggattatagtggaatgccccattccaatccagtcctctttaaatttcatagaatattgaataattattattttgcaagttacgtataatgtcgtcttcagtctttacatgatgtctccatacttgcagctaatctaactggacaaggaatatcactgagacaaataacatcacacaattgtaggagtgaatctactaggaggatatttagaatcactaggaaatcaaataaagtagaacttcttcccatacctaattattggtttcacatagatctgacgttggcctctctctcccaagacataattttctaaatcggcaagctagtttttaataaagcaatatttgaaatttgcttggtatatctggatgtaatcaaatttaatcccaaatattgaatttcaacattacaacaaaaaaagaaaaacacaagattagaaagagttttatttaattttctccccaagtccaaagacaaaagattccagtcggagtccagtgtgactcttctatttactgttcagggtatgacagtcacgctaacaatctggtaaatgcagtgcacaaatgcctatttctatcaagtcacaagtaaactgtgcttttctttatgtttttaaagggcctctgctaatttagagagacctatccatttcaaaattgtgtcatattgaatgttttttcacctcacctggggtaaattcccaccgcggtcattgtggttgcctttcctttcctcatgtaaaaatcgcatttgcaaaggaattggatatggtctgtgataactatcttacaagttgtaataatataaagaacttcctgtgaatgttgttgactttagattttctggttcatttcaccctcattatatcaagttattgaagattgatgttaaactacatgtgccttgttacaaaaccttatgatgcaataatgcagaaatgtgtgtaattcatagtttggaatcatattcagactgtggtgttaaattttttgctgcaaaatgtatttctttttacaagtgaatgaagaatgaaagggaaagaatgtgtgctgtattgttgtgtctatgatgagttccagaatttatctttagatctggaagtactttgttggaagcccttaatttgatcttttgagtaactgggctttcaaacagctatttcttagagaagccaagtgtaagaattagtgtagttggatacacatgtgtaaatctattgacaatacaaaaatgttgctatgttcttgatgttattagtaagcagtgaagattttagcatggtctgtatagggacagatttcctacttccatacctatgtacacacacaagattgcattattgctgttcaatgataccttccattccaataccttatgtttcaatattggttcagtactgcctaaattaataccaagcttcatcttattgataaatatctgaaacagaaggccaagttctgaggataaaagtagtggaatttaaaaagttaatttccaacttagtaatttagcagtaacatcaacatccatgatatgtatgtggacacaggctggagtcaggttcgccatctgagctaacaaacacgtgtgtaagagcttttctactcactaatttaacagatggcatgaatgaaaatgtgctctgtcattttcctagtttcatttcaataacattttataaggaaataagagacttttttacattttcttttttcttatgtgataattccactagctcacataaatattggtggtttctaatggtaaaatcaatgttaccactgcttgagatgaaaaccttttgaacttgtccatatgaataaaagttatcgaaggtatgattgaatacaatttaagctaatgttgattttggaacctataatgagggtaaaattctcgatcttataatagtctgtgttttcccaaacgaccacgtgatgtagagtccacatcactttcctgcaaatctctcggcttatgtgaaggcattactttaatggtcttcttcactatcaaatgtaatgctgtaactttggtttgttcttgcttattctcacttgtgttgtattgcatttatttcccaaggcctggacccagtactctgggcctggttctttcttcaaaatgaaaataacgaatgacagtgcttctgttcaaggatataaggcccaattcacccactgtgtatcttcatgaatggaggcttcagatttttctgaaatcgtgggcaaaattacttaacttttggccatgtgaagtgatattcaagcaattaattttaaacaagccaaggttttccattaccttacaatgtataggcccaaaagacaacttaagatcaaaatatgtcatccaaaagatgcctgagcatttgaaaacctgaatataatttgaaaatatgttttcctgcgatgatgggacattgcttgtagcatcagaaatgtatatgttgggcctcttttctctggtagactttaaataatgatcaaactgataaagatttaatttattaaatttccttaaatctc

SEQ ID NO: 166178 - DNA, 2687 bp, Homo sapiens
  Payload ID: 12710
  Gene Symbol: PIF1
  Gene Name: PIF1 5'-to-3' DNA helicase
  Uniprot ID: Q9H611
  ENST ID: ENST00000268043
  CDS Start-End: 96-2021
atttgaaaaatttctagtttcggagcttagccacaggccggctacgatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagagaagacaaagggtggcctgtggcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaa

SEQ ID NO: 166179 - DNA, 2278 bp, Homo sapiens
  Payload ID: 12710
  Gene Symbol: PIF1
  Gene Name: PIF1 5'-to-3' DNA helicase
  Uniprot ID: Q9H611
  ENST ID: ENST00000333425
  CDS Start-End: 96-2219
atttgaaaaatttctagtttcggagcttagccacaggccggctacgatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaa

SEQ ID NO: 166180 - DNA, 2677 bp, Homo sapiens
  Payload ID: 12710
  Gene Symbol: PIF1
  Gene Name: PIF1 5'-to-3' DNA helicase
  Uniprot ID: Q9H611
  ENST ID: ENST00000559239
  CDS Start-End: 91-2016
gccacaggccggctacgatctgcttgttcatctgagtgtcggcacaagtgagtgtctgcccgaacccagagaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagagaagacaaagggtggcctgtggcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgt

SEQ ID NO: 166181 - DNA, 371 bp, Homo sapiens
  Payload ID: 12711
  Gene Symbol: PIGBOS1
  Gene Name: PIGB opposite strand 1
  ENST ID: ENST00000565225
  CDS Start-End: 283-371
gtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacggtaacgatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttga

SEQ ID NO: 166182 - DNA, 801 bp, Homo sapiens
  Payload ID: 12711
  Gene Symbol: PIGBOS1
  Gene Name: PIGB opposite strand 1
  Uniprot ID: A0A0B4J2F0
  ENST ID: ENST00000567948
  CDS Start-End: 331-495
gctcgcaagcccggaagtaaccgggaacgggcaacttcgtagctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacgatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaa

SEQ ID NO: 166183 - DNA, 866 bp, Homo sapiens
  Payload ID: 12711
  Gene Symbol: PIGBOS1
  Gene Name: PIGB opposite strand 1
  Uniprot ID: A0A0B4J2F0
  ENST ID: ENST00000436697
  CDS Start-End: 258-422
ggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacggtaacggtaattgtagacgtcagtgttggtgttaacatttcagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaa

SEQ ID NO: 166184 - DNA, 3100 bp, Homo sapiens
  Payload ID: 12712
  Gene Symbol: PGBD1
  Gene Name: piggyBac transposable element derived 1
  Uniprot ID: Q96JS3
  ENST ID: ENST00000259883
  CDS Start-End: 406-2835
gtacccgcccagctgctggaggcgccggcagcgcccgccagacccgccagcccagcggcccgggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgctgggtgtaatctcagaaaaatacattcaggggcgcgcctgagggtgctggctgctggcatctcaggtgctttacgtgcattcgtgaagaagcccatcagtatttcttgaataccagatctctatttctgaatatagaccccaagctaagtgaagctttagcctctaagctcaacatgtatgaagctttgccaggccctgctcctgaaaatgaagatggccttgtgaaagtgaaggaggaagatcccacctgggagcaggtgtgcaactcacaggagggcagctcccacactcaggagatttgccgcctgcgctttcggcacttctgctaccaggaggctcacggaccccaggaagctctggcccaactccgagaactttgtcatcaatggctgagaccggagatgcacaccaaggaacagataatggaactgctggtgctggagcagttcctgaccatcctgcccaaggagctccagccctgtgtgaagacatatcctctggagagtggagaggaggcagtgacagtgctggagaatctagagacaggaagtggagacacaggacaacaggcctctgtctatattcagggacaggacatgcacccaatggtggcagaatatcaaggagtctctttggagtgtcagagcctccagctcctgcctgggataaccaccctgaagtgtgaacctccacagcgtcctcaagggaacccccaagaagtgagtgggcctgttccccacggatcagctcatctccaggaaaaaaaccccagagacaaggctgtagtgcctgtgtttaacccagtcaggtcccagacattggtgaagactgaggaagaaacagcccaggccgttgctgcagagaagtggtcacatctgagtctgactcggaggaacctctgtgggaactcagctcaggagacagttatgagcctcagtccgatgactgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatccctggaatatgctgcaggagacattacccgaaaagggagaaaaaaagacaaagctcgagtgagtgaactgctccaaggcctctcattctctggtgactcagatgtggaaaaagataatgagcctgagatccagcctgctcaaaagaagttaaaggtatcatgtttcccagaaaagagttggaccaaaagagacattaaacccaattttccaagctggtcagcactggattctggacttttgaatctcaagagcgaaaagttgaacccagtagagctttttgaattattttttgatgatgaaacattcaacttaattgtcaatgaaaccaataattatgcttctcagaaaaatgtcagcttggaagtcacagttcaggaaatgaggtgtgtgtttggtgtcttacttttgagtggatttatgaggcatcctagaagggaaatgtattgggaagtctctgacaccgatcagaacctggttagagatgcaatcagaagggacagatttgaattgattttctcaaacctgcactttgcagataatggccacctagatcaaaaagataagtttacaaagttgagacctctcataaaacaaatgaataaaaatttcctcttgtatgctcccctggaagaatactattgctttgataagtcaatgtgtgaatgctttgatagtgaccaattcctgaatggaaagcctattagaattggctataaaatttggtgtggtacaaccacacagggttatctggtttggtttgaaccctatcaagaagaatcaactatgaaggtagatgaggatcctgatcttgggttaggtggaaatctagtgatgaacttcgctgatgttcttttagagagaggtcagtatccctatcacctgtgttttgatagcttctttacaagtgtcaaattgttgtcagccttgaaaaagaagggggtgagggcaacaggaacaattcgtgagaacaggaccgaaaaatgtccccttatgaatgtagaacatatgaaaaaaatgaagagagggtattttgatttccgaatagaagaaaacaatgagataattttgtgtcgttggtatggggatggcattatcagtctgtgctccaatgctgtgggcatagaaccagtcaatgaggtaagctgttgtgatgctgataacgaagaaatccctcagataagtcaaccatccatagtaaaagtgtatgatgaatgcaaggaaggtgtagctaaaatggatcaaattatttcgaaatacagggtgaggataagaagcaagaaatggtactcaattttggtgagctacatgattgatgtagccatgaacaatgcatggcaactacacagagcctgtaacccaggtgcttctctagaccccttggattttcggagatttgttgcacatttctacttggaacacaatgctcatctgtcagattagggtacataaaatggacatagtgcagacattaataagacatagaaaaataataattatacatgctgttgtaccctcccaaagtaaatctgatatatgtaatgaagttattaaataatacttttaaaaatcagacatttatatagagtttcaaagactattgtaacaagtaatgttaaaaattgtctgtgagaatgttgaactgtagtacctttctctatgtcaagttttgtgtcagacatgggaaatcatgtatttgttcaattga

SEQ ID NO: 166185 - DNA, 2136 bp, Homo sapiens
  Payload ID: 12713
  Gene Symbol: PGBD2
  Gene Name: piggyBac transposable element derived 2
  Uniprot ID: Q6P3X8
  ENST ID: ENST00000329291
  CDS Start-End: 148-1926
cgcggccgcgacgcccgacgccaacgcaggcgcagcgctccgattcggcgcggctcatggtccggttcgggctcgcgagtctccgtctggggtagggcaggttcttagactctgtgagtaaagacagcttcatcttcccagttcatcatggcttcaacatccagagatgtcattgctgggagaggtatccactcaaaggtgaagtctgcaaagctgcttgaggttctgaatgctatggaggaggaagagtccaacaacaacagggaagagattttcattgcacctcccgacaatgctgcgggggaattcactgatgaggactcaggggatgaagacagccagcgaggtgctcacctacctggcagtgtgctgcatgcttcagtcctgtgtgaggactctggcaccggggaggataatgacgacctggagctgcagccagccaagaagaggcagaaagcagttgtgaaacctcagcgcatttggaccaaaagagatattcgtccagactttggcagttggactgcatcagatcctcatattgaggatctgaaaagccaagagctgagtcccgtgggcctttttgagttgttttttgatgaaggaacaattaatttcattgttaatgaaaccaatcgttatgcttggcagaaaaatgtcaatttgagtcttacggctcaggaattgaagtgtgttttgggcattttgattttaagtgggtacatctcttatccaaggagaaggatgttctgggaaacctctcccgattcacatcatcatcttgtggctgatgcaattagaagggacagatttgaactaatcttctcatacttacattttgcagataacaacgaacttgatgcaagtgataggtttgccaaggtcagacctctcatcatccggatgaactgcaatttccagaagcatgcacccttggaagagttctacagctttggcgagtctatgtgtgagtactttgggcaccgggggtccaagcagctgcacagggggaagcctgtgcgacttggctacaagatttggtgtgggacaaccagcagaggctacttggtgtggtttgagccctcacagggcacactgtttaccaagccagacaggagcttggatctaggaggcagtatggtaataaaatttgtggatgcgcttcaggagcgtggttttctgccatatcacatattttttgacaaggttttcacaagtgttaaactgatgtccattttgaggaaaaagggggtgaaagccacaggaactgttcgtgagtacaggactgagcgatgtcccctaaaagaccccaaagaactgaaaaaaatgaagaggggttcatttgattacaaagtcgatgagagtgaggagatcatcgtgtgccgctggcacgatagcagcgtggtcaacatttgctccaatgctgtgggcatagagccagtgaggctgaccagtcgtcactctggagcagctaaaacgcggactcaggtccaccagccatcactggtgaagctgtatcaggagaaggtgggtggcgttggtaggatggatcagaatattgccaagtacaaggtgaagatccgaggcatgaagtggtactcaagctttattggctatgtcattgatgctgccctcaacaatgcatggcagctgcatagaatctgctgccaagatgcccaggtggacctccttgccttccggagatacattgcctgtgtgtatctggagagcaatgctgacacaacatctcaagggaggcgaagcaggcggttggagactgagagccgcttcgatatgattgggcactggattatccatcaggacaagaggacccggtgtgccctctgccactcacagaccaacacccggtgtgagaagtgccagaagggtgtccatgccaaatgcttcagggagtaccacatccggtgacatcatgagacatgcttctttggtttataatgagatgtttacagttaaatacagatggcagttgagcacttctgttttgtgttggaaaaaagacctgaatttctaatgacttgattttctattttctccctacccacaatacagttatcttttttattgtgttgtgttatgcctacatgtgatataaattaatatttatattcatttata

SEQ ID NO: 166186 - DNA, 2879 bp, Homo sapiens
  Payload ID: 12713
  Gene Symbol: PGBD2
  Gene Name: piggyBac transposable element derived 2
  Uniprot ID: Q6P3X8
  ENST ID: ENST00000355360
  CDS Start-End: 271-1296
atggaaggccggccgaggtgcagcgagccctctggtgccggacgttgcgcggccgcgacgcccgacgccaacgcaggcgcagcgctccgattcggcgcggctcatggtccggttcgggctcgcgagtctccgtctggggtagggcaggttcttagactctgtgagtaaagacagcttcatcttcccagttcatcatggcttcaacatccagataacaacgaacttgatgcaagtgataggtttgccaaggtcagacctctcatcatccggatgaactgcaatttccagaagcatgcacccttggaagagttctacagctttggcgagtctatgtgtgagtactttgggcaccgggggtccaagcagctgcacagggggaagcctgtgcgacttggctacaagatttggtgtgggacaaccagcagaggctacttggtgtggtttgagccctcacagggcacactgtttaccaagccagacaggagcttggatctaggaggcagtatggtaataaaatttgtggatgcgcttcaggagcgtggttttctgccatatcacatattttttgacaaggttttcacaagtgttaaactgatgtccattttgaggaaaaagggggtgaaagccacaggaactgttcgtgagtacaggactgagcgatgtcccctaaaagaccccaaagaactgaaaaaaatgaagaggggttcatttgattacaaagtcgatgagagtgaggagatcatcgtgtgccgctggcacgatagcagcgtggtcaacatttgctccaatgctgtgggcatagagccagtgaggctgaccagtcgtcactctggagcagctaaaacgcggactcaggtccaccagccatcactggtgaagctgtatcaggagaaggtgggtggcgttggtaggatggatcagaatattgccaagtacaaggtgaagatccgaggcatgaagtggtactcaagctttattggctatgtcattgatgctgccctcaacaatgcatggcagctgcatagaatctgctgccaagatgcccaggtggacctccttgccttccggagatacattgcctgtgtgtatctggagagcaatgctgacacaacatctcaagggaggcgaagcaggcggttggagactgagagccgcttcgatatgattgggcactggattatccatcaggacaagaggacccggtgtgccctctgccactcacagaccaacacccggtgtgagaagtgccagaagggtgtccatgccaaatgcttcagggagtaccacatccggtgacatcatgagacatgcttctttggtttataatgagatgtttacagttaaatacagatggcagttgagcacttctgttttgtgttggaaaaaagacctgaatttctaatgacttgattttctattttctccctacccacaatacagttatcttttttattgtgttgtgttatgcctacatgtgatataaattaatatttatattcatttatatttatatttttgaacttatttatttaaagttatggatcactttttattcaaataaaagttgtgctttggggtatatttgaatcctagcaagaataatcaaaggaaaacttgcaagaacagtaagaagactttaccattgcatgccatggtttataatctaagataggcaatagtgtataaatatcatgtaaatgtgatggatttcttaatcatatttatttcatattaatccaagtttatcaaacttttgagggataatctgccttgtatttagtcagagggctagaggtgcagatttcatattttcttaatgaaaatattttcctaatacacatatatcaatgtgagattcatttttgtaaaaaaaattatttttttaattttgtgggtacatagtaggagtgtatttttatgggttacatgagatattctgatacaaacatgcaatgtataaaaatcacatcagggtaaatggggtatccatcttgtcaaacacttgtcctttgtgtttcaaacaatccaattatactgttagttattttaaaatgtgcaattaaattatttttaactatattcaccctgttgtgctagcaaatactaggtcttactcattctttctattttttcatacccattaactattcccactctcccccaccccctaactaccctttccaagctctggtaaccttctttccactctgtgtgtccatgagttcaattgttttcatttttagctcccacaaataagtgagaacatctgaagtttgtctgtctttgcttggcttatttcacttaacataatgacctccagttccattcatgttgttgcaaatgactgaatatcatttttttgtggctaaatattaatcacacttcattgtgtatatgtacattttctttatccattcttctgttgatggacacttaggttgctcccaaatcatgactattgagaatagtgcagaaaataaacatgagttcagatctttcttcaatatactgatttttttttcttttggatgtatacttaggaatgggattcctgaatcatatggtagctctatttttagtttttgaggaagcttcaaactgttctccatagaggttgtactaatttacattcccaccagcagtgttcaagggttcccttttctccacatccttgccagcatttgttattgtctgtcttttggattacagccatttctgcccggatgagatatctcaatgtagttttcacttgcatttttctgttgatcagtgatgttgagcactttttttatacctgtttgccatttgtaccttttgtttttattttgagatggagttgccttgtcacccaggctggaatgcagtggtgcgcaatctcg

SEQ ID NO: 166187 - DNA, 2212 bp, Homo sapiens
  Payload ID: 12714
  Gene Symbol: PGBD3
  Gene Name: piggyBac transposable element derived 3
  Uniprot ID: Q8N328
  ENST ID: ENST00000374127
  CDS Start-End: 203-1984
ctatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaagtcccaagatgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttctaatttgcatgttgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacagagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaactggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttcaaatttttgttccttgaatttttctaggtaacatatatgaatttcatgcaaaaattcaaaaaattgtaacctcagacataaatgggttaaagatgt

SEQ ID NO: 166188 - DNA, 6612 bp, Homo sapiens
  Payload ID: 12715
  Gene Symbol: PGBD4
  Gene Name: piggyBac transposable element derived 4
  Uniprot ID: Q96DM1
  ENST ID: ENST00000397766
  CDS Start-End: 460-2217
tgtgtcaagtgcctatgaaggggactgcccatgaagtgaaagtcaagtgtgtgttgctgcggcagccacggaggccaaggacctcacgggagtaaaagatgacgagactggcttcgggagaaacaccatccagaagagacctttcaaaaaacttctagagactccccaagacgtatgagatgaaaggcttcttctgtctgtgtgcgtttaactcatttctccttagccccgagattacgcgctgctgtgcctgcgactgcagcgtttacgccgagataactcgtggattacagtgccaaccttactcccaaagtttgccacgaaatatctcgcttctgttattttcgcatggttctggtatattgacttttgaaacaaaagacatcattctgtttatagcattctgtttttagtagtgggatttccatctacaaaatatagtaattctcgatcgctgaaatgtcaaatcctagaaaacgtagcattcctatgcgtgatagtaataccggtctcgaacagttgttggctgaagattcatttgatgaatctgatttttcggaaatagatgattctgataatttttcggatagtgctttagaagccgataagatcaggcctctgtcccatttagaatctgatggaaagagctctacatcaagtgactcagggcgctccatgaaatggtcagctcgtgctatgattccacgtcaaaggtatgactttaccggcacacctggcagaaaagtcgatgtcagtgatatcactgacccattgcagtattttgaactgttctttactgaggaattagtttcaaaaattactagagaaacaaatgcccaagctgccttgttggcttcaaagccaccgggtccgaaaggattttcgcgaatggataaatggaaagacactgacaatgacgagctcaaagtcttttttgcagtaatgttactgcaaggtattgtgcagaaacctgagctggagatgttttggtcaacaaggcctcttttggatacaccttatctcaggcaaattatgactggtgaaagatttttacttttgtttcggtgcctgcattttgtcaacaattcttctatatctgctggtcaatcaaaggcccagatttcattgcagaagatcaaacctgtgttcgactttcttgtaaataaattttccactgtatatactccaaacagaaacattgcagttgatgaatcactgatgctgttcaaggggccattagctatgaagcagtacctcccgacaaaacgagtacgatttggtctgaagctatatgtactttgtgaaagtcagtctggttatgtgtggaatgcgcttgttcacacagggcctggcatgaatttgaaagattcagcggatggcctgaaatcatcacgcattgttcttaccttggtcaatgaccttcttggccaagggtattgtgtcttcctcgataactttaatatatctcccatgcttttcagagaattacatcaaaataggactgatgcagttgggacagctcgtttgaacagaaaacagattccaaatgatctgaaaaaaaggattgcaaaggggacgactgtagccagattctgtggtgaacttatggcactgaaatggtgtgacggcaaggaggtgacaatgttgtcaacattccacaatgatactgtgattgaagtaaacaatagaaatggaaagaaaactaaaaggccacgtgtcattgtggattataacgagaatatgggagcagtggactcggctgatcaaatgcttacttcttatccatctgagcgcaaaagacacaaggtttggtataagaaattctttcaccatcttctacacattacagtgctgaactcctacatcctgttcaagaaggataatcctgagcacacgatgagccatataaacttcagactggcattgattgaaagaatgctggaaaagcatcacaagccagggcagcaacatcttcgaggtcgtccttgctccgatgatgtcacacctcttcgtctgtctggaagacatttccccaagagcataccagcaacgtccgggaaacagaatccaactggtcgctgcaaaatttgctgctcccaatacgacaaggatggcaagaagatccggaaagaaacgcgctatttttgtgccgaatgtgatgttccgctttgtgttgttccgtgctttgaaatttaccacacgaaaaaaaattattaaataccgatcatcatacacatctgttccattaggattagagacaagttctgtttagaaataactccaagattgggaggccgacctgggtggatcacctgagatcaggaattcaagaccagcctggccaacatggtgaaaccctgtctctactaaaaatacaacaattagctggatgtggtggcacatgcctgtaatccaagctacttgggaggctgaggcaggagaattgcttgaacccatgaggcggaggttgcagtgagctgagatcacaccactgcactccagcctgggtgacatagcgagactccatctcaaaaaaaagaaataactccaagaacagttttgttgtttttgttttgttttgttttgttttgagacggagtttcactcttgttgcccaggctggagtgcaatggcatgatattggctcactgtaacctccacctcccaggttcaagcgattctcgtgcctcagcctccctagtagctgggattacaggcatgtgccaccacacccacctaattttgcatttttagtagagactgggtttatccatgttggtcaggctagtcttgacctcccgacctcaggtgatccgcctatctgggcctcacaaagtcctgggattataggcatgagccactgcgcctagcaccaagaacagtttttatattttattttcacattgaaaatcagtcagatttgcttcagcctcaaagagggtgtttatgtaaaactaaatgagtgcaggcagcgagctacacttttttttttcctaaatggaaaatgggaaggagatactgtctctgaacaaaaatagctggaaaaacacataactgttaactaagggttgcctctagtgaaaaggattggaagacaatttatctgatgctacactattcttcctgttgtgattgttttactgtgaacataacaaggttgtattggggaggagggcaggggttgattgctgccaatgttgattgctgaggccttagccaagatttcaggcatcatttgctccagtcctttcattttctttatggtggaaagtgaagtgacttgcccaagatctttgttggccctaaacatcgctgtctctgctacagattcctattgagagcaatgcatgttttagccttgtgcactcttagagtcagcatcatgggaaagagtaacagcaattgaaaaaagagattcaagagccaagtactcagccctggcaggggatggggacatgatgcccagagccacccctatactccagtctccctggcatcagctactgcagtactggggtacttgccttcatcttttttctgaagatagttacttcttcatatttgatcatcggaaggagcagcattgctcagaaacacacacacacacacacacacttgactttcttgtctgccaaataaatttcttatttgctagggaactggtaatctaggctcaagaagtgtgtggagaaggtttattttcattctttttactttaaaatatgccttagtttttgaatagataagacattcaagtgtcagaaagtaaaagtcagttcaggactgagaaaggaaagatcagtgctgattttaatcagactgtaatgtaccaactagatacagacagggccagtggcaaggccatcagaaaacttcttcccaaggccacaccacacctgcaaaatgcctaacaaccttcttcttttcagtgattaccactttcttaccaatgacttcgctttgttcctcgtgcctctgaacagactgctgagatacccaatcaagagccaatccttgcttccctagactctcctcaatcattcaacagaagcccaaatcttgtaaaagttcctttctgggccgggcacagtggctcacgcctgtaatcccagcactttggaaggccgagatgggcgaatcacaaggtcaggagtttgagactagcctggccaacatggtgaaaccctgtctctactaaaaatacaaaaaaaaattagctgggcatagtggtgggtgcctgtaatcccagctacttgggaggctgagacaggagaatcacttgaacccgggaggcagaggttgcagtgagccaagatcgcaccactgcactccagccctggcgacagagtgagactccatctcaaaaaataaaaaagtttccttctgttccctcttactgttatatccttggtttctctggtgtggggtcttccttacagcagcaagctcataaacttaacttgaccgcaggtgtgttccttggtggtctttatctgatagactttgtcacatggtacaatattcaaaaggcacatggtacaatattcaaaaggcacatggtacaatattcaaaaggtatgagtatacaaaaaaaatctcccacctacttctctccctagtcacccaattctcaagaggcaatcactgttgccattttcctgagtattcttccacagatagtcaactatctacagaaaaatatatacattaaaaataaggccaggcacagtggcatgcctgtagtcccagctactcagaaggttgaagcaggaggatcacttgaggccaggagggccaggaatttgaagctgtagtgtgctatgatagcaggcctgtgaatagccattgcactccatcctgggcaacatagccagaccctgtctctaaaaaaaaaaaaaaaaaaaaaaaagacaaaaaaacaaatccatatatacatatatatgtatatatatagtatgctaccagttgtgtgaaaaaaggggcaaaatatatatttatttaacttatatacaaataacattctagaaataaattgtttaatataaaatacactaatatataataatgtattacctaacatatgattatatataactataatgtgtactgttttacatacatatttccaaagtatactataaatgcacttccgcactttgctctttttactaaatatatcttggaaatcatcctttattcgtacataaaaagcttcatagttcctttttatggctgcaaaatgttccagcttatggatggactgattctctatcgagcaacattaagattgtgtcctattttactattcctaattttgctgaagtgaatttcttttgccatgtgatttccacaggtgtatatatgtagcgtaattagtactagtagaaagtagaattgctagatcaaagagtatgtgcctttgtaattttgatgatattgtgaaatcttcttccacagaagttgttgcaactttcactctcaccagcaatgtgtaagataacttgcttcttcataccctcaccaacaatgagctatcaaatgttatttttgccaagcaaataaattaaaagtgatatctcagtttttgtttgtttgtttgttttttgagacagagtttcactctttgttgcccaggctggagtgcagtggcgtgatctcggctcactgtaacctccgcctcccaggttcaaacgattctcctgtctcaccctcccgagtagctgggattacaggcacctgccaccacacccagttaatttttgtatttttagtagagacagggtttcaccatgttggctaggctgacctcgaactcctaacctcaggtgatccacctgcctcggcctcccaaagtgctggaattacaggcgtgagccaccatgcctggctcttcttgcttgtttgttttgagacagagtcttgctctgtcagccaggctggagtgcagtggcacgatattggctcactgcaacctctgtctcccaggctcaagcaattctcctgcctcagcctcctgagtagctaggattacagatgtgtgccaccacgcctggctaatttttgtacttttagtagagacggagtttcaccatgttggccaggctggtctcaaactcctgacctcaggtaatccgcctgccttggcctcccaaagtgctgggatgacaggcgtgagccaccacgctgggcctcttcttggttttttaatccatcttctgccatatggtgaattaaatctaagttgtattgtaggattaatggagagcagctaaagaggaataaagccatgtgttcagccaaggatagttatcatgaaggataaaagcctcaaaatcctgattttgaaatacaaagtgctgattttaaaatcagtacatgttgagctgagccctgaggcctttgtttcagtcccaaccagagcagaagtaagcattgttgaaaccgtagtaaaaagattatttgagaaataatggaatgggacaaaggattataatgtgctacagccctctgaccattacactttctaaactattaataaaattttacttttcaaaaatgatttcaaaaattgcaaaatttagaaatatgctgaaataaaaacagcttcatccc

SEQ ID NO: 166189 - DNA, 10319 bp, Homo sapiens
  Payload ID: 12716
  Gene Symbol: PGBD5
  Gene Name: piggyBac transposable element derived 5
  ENST ID: ENST00000391860
  CDS Start-End: 147-1376
cgggacccccaggggccgccccgccaccgccccgcgccccggacgcacaggagccggaggaggacgaggccggcgcgggctggagcgcagcgctgcgggaccgcccgcccccgcgcttcgaggataccggcggtcccacccgaaagatgccccccagcgccagtgccgtggacttcttccagctctttgtcccagacaacgtcctcaagaacatggtggtgcagacaaacatgtatgccaagaagttccaggagcggtttgggagcgacggagcctgggtggaggtgacgctgacggagatgaaggcgttcctgggctacatgatctccaccagcatctcccactgcgagtccgtcctcagcatctggagcggaggcttctacagcaaccgcagcctcgccctcgtcatgagccaggcccgcttcgagaagatcctcaagtacttccacgtcgtggccttccgctccagccagaccacgcacgggctctacaaggtccagcccttcctcgactccctgcagaacagcttcgactctgccttcaggccttcccaaacccaggtgctacatgaacccctgatcgatgaggatcctgtattcattgccacgtgcacagagcgggagctgcgaaagaggaaaaagcggaaattcagcctctgggtcagacaatgttcttccactggcttcatcatccagatttatgtccacctgaaggaaggtgggggcccagatggcctggatgcgctgaagaataagccccagctccacagcatggtggccaggagcctgtgccggaacgcggcaggcaagaactacatcattttcacggggcccagcatcaccagcctgacgctgtttgaagagtttgagaagcaagggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctatttagatgttgattctccgttaatacgtgaattcgtttaaaaggtcagggaacaggcggggtgcggtggctcatgcctgtaatcccagcacttttggaggctgaagcgggcggatcgcttgagtccaggagtttgagaccagcattggcaacatggcgaaagcccatttctacaaaaaatacaagaattaggtgtggtggcacatgcctgcagtcccagctacttgggaggctgaggtgggaggatctcttgagccactgcactccagcctgggtgacagagccagaccctgtatcaagaaaaaaaacaaggtgaaggaacaaaaatacaggctactcttttaaatacttgattttttttgttatataatctggtgtgtatgatattaactgttcttggtgtctcaaaccactgagcagtttaaaaaagaaatgtttttgagtttggctaatagaaatacctcttgatgttgcagttgtatgagtgcagttgtatttgaggtgcctgtttcattgaagacactagcaggcctgccttccggcctggtggttttccctcttttcttctagtttgtgtcgtgtgtcattccagatgagcaggaagaggtgctgttctgacaggcagtgggtggctgcattccccagtcatgagagaataattgtaacattgtaacactctgtttctaaaatggcagccacctgttgtctgatacatgatgggaaaaggcagctgttgagccgggtctaggggaggcttcagtggccacttcaggtctctggaggaatgctgttgactgagaagagtttctcttctccatccagaaggacagaatagcatgtaggacggactgacagaacctccagggacctggaccttgccttagagatgtgattcaaagtggctttttggagtgactctagttgaagtgcatctggttccagtatctccctgggttcaacagccctcaggttgattcttgattggctttggagtagctggccatccctggggatgaggaaagagcatcgtaagtggtcttatgacagagggagccagcatggccctggctgagtatatggggctggcaagcaccactgcacacatggcaagtgagagcccattccactcagatccagccactaagccaagccgatcccctgagggatgtctctgctgcaggctctggaaaaaaaagatggagcaatgagcttcccagccttatgcaaaacaaaacacccacaaaaacttccaagcttctccaaagagaatctgcatttccctgcaactcacagggaattgaacctgcactgagcttcacggagtttatgagaccttcccattactgcagttgtgttgagcgtcccgtgaggtccttcttaggcaaatttaacttcattgagtgaatgtctgtttctgtttggtgcctacttgatcaggttccatattcgactttcattgtctttccccacactctgctccctaaagagcctcgattttggccaggtgcggtggctcacacctgtaatcccagcactttgggaggccgaggcaggcggatcacaaggccaggagattgagaccagcctggccaatatggtgaaaccccatctctactaaaaatacaaaaattagctgggtgtggtggtggacacctgtagtcccagctactcgggaggctaagcaggagaatatcttgaatccgggaagcagaggctgcagtgagccaagatcgcaccactgcactccagcctgggtgacagagcgagactccaacccccaccccgccacaaaaaaaaaaaaaaaaaaaaagcctcgagtttgaacaacgtcttcccgtggtccatgggacattatactagggacatctttcaaaagtcaggcaagtcatatggaaaagtcttggtggctgggtcattctgagcaaacacatccagtactgactaaatcagatgaggcttggtcaccaaaattgagttaactctgctgcgtgcaagaagcaagaagattgcaggtccccaggacagagcctggaaggttctgaatccttcctgtgtggcccgtgtgtcaccatcctccccagggacccaggctcagcccccccaacagtgagggggggtcaccaagcatcaggctgagaggaagcagggcaaacccgggagggccatggggccttgcaactacgcaagcctcacacattctcctccagtctgcattcatggcaaaaaaaaaacatttccccacttgcctgggattggggcgagaacaagtcaacgacactgatgggggagaaaggtgaccttgggtgtggtacctcccagatctgtctcctgcatcctcgcaggtgctgtgtttgaaaggtatgacagcggtggctaacaggcaggcacacttccaggcggcttggggtggcccttctgccccagagccttactcctcacagggatccctgtgggttaggcatggactgtcaccacgcccagatggagtggtgcaatggttcgcccaggtaagcagacccgggtttgcctgacgcaggaggccgcgtcctaactgctgtgggcactggctgtcctgattcatcacgaggacgggggattttatccctgacttacctgacaactttgtgggggattttctcctttccatatccaatcctctctgctgatccgaatactgaaaacaatcattatgagatccgggacatcaccctccccctgggtccttttcttgtcctagatggagatgggtgttttggagcttaacaactactgaagctgaagttagcctggtagggagccactattctggggggcatttggacagggcaagcccttggccacaccagaccctgagccagaaagaaccatagcgatttcctcacccagatggccccagctcacagtatggggagagtgggatggggtgggggagtggagccagctgtggggtctcatcagagtgccctgggatctaggccagaggcgccgtcttcacccacatgccagctttgtggttctggtccctcttccttaagcgagggcttgccaagctttggctgtggaaagccttagccttgtgtagtgggagttccaaacgaaagaagtccccagaagttcacaaggtagtggccagggaaagtgtccccagtgccccctccccaccggtggcctctgcagcttgctttggaaaacagttctgtctgtgaagaaatctctcctgttacggccctgtgtcagtcaatgcgggcttggctgtctgcccaaataccttccgttcttatcaggaacatgactgaggcttctcacttttgactccatcacttaatccctttttctccgtggcttctgtgtgtctcatcttcgagaatatttctcagccttctttgcaggtatgttattctctcccaataagaaataaagagtatcaggtaccaaagtggcacttagagctgttgccataaaatagcaccagagagtaagcatgccctctggccacgcagctcgctgccatttagccatctctgtgtccctccctccctggggtgcccagtgcgcaccccagttctccagcagcccaggcacattctcctagctctgacccctgtctggtgggggccgggcagcctctcttgagtgtagggcggtggtgctggcgctggtggcagctctgtgtgaactgtgttccggggagggtggggcaccttcacccttccgtgtatacccatgtatacacggtcgtaatgaggagactcctgcgggagacttgattgtgcgctccatgtcactagctactctacaagcagatactattcttcaggttttttccttagttgcctggaagcttgaccttgtgtgcatgtatttggagatgaaaacagaaagggcggggaggacatcggcttgtgtgaaagacctaggaagacgatggaggagtgtgtgcggcttccctcacgtgtcaagcctcctggctccctcaggtggaaggggcactttatggccaaggaaattcagtgaggagtgaagggtgaggctgagcccgccagataaatcagcctcggccctcccctccccaagggtcagcccccggcagcgcacctctgttcttggtgcgtctcgctagtctttgattcattcttctgccgtcttcacccaagcctcgctggactaaagagtgacagttaatgcacatggagcatttctgttccagcaggtcacgtctccctgtatggttcctttgctgagtcctcagcattgccctgggagctgacaaccatcggtcccccttttgtgatgggaaagtgacactctgagagccgtggtgactctacagggtgtggagccaggttgaccctcactctgtctgctccagggcttcctggttctcagccactgctgcttctgaactgctacaggccaggcattgtgctaagaactgggcacgtgttaccccaacgtggtctgtgcccttgagggtgccatgactgaaacacgttgggggcacagagcaggctgattctccgccgaaagaaggctccagccagaggccgagaccccgtgtgggggaggtggcagtcaccattgctgctggactcagcaacccccagaccctccaccttgcttggcaggcatcacatgcacctggcttagcacatccctgcaaacacaagagtctgagcctcctcaagaggctgcagtcacactgcatttgaccaggacttgccaacctgcaacttgccctgagagccaggtatgcgtgtgtgtatctggggagcacgccccaaacatgagcagggacggtgttcccagctatccgagaggtcatgcccaagccaaaaggaaggctctagctcttaaacatgaataagtttattcctttcatttccacagtgtcttatgcttgcttctgttttctccaaggaagtatggtgcccacctactcctccagcctgacgatccatgtgagggttccttgttcccagcccaattctcatgtcccacctttctccactaagaaacagccaaattttggcaagagtcgtggtaggaaaaaaaaacaataattgggcagatgaggatttttcactttttgactagttctttctctagactttcctgtctttttaaaacttctagtttcccccttgagcgctccctcccagtgggtagaccacggaaggaatgaacaggggatggaagcaggggatgcagtccctattatttcaatagattggaaagatgggcccagaacaattgcgtacggtgttcagtgtaaattgaagatctggagttgcaggattgttgaggcaatttttagttgctttgctccatctaaacacaaggccataggatagtgtgactttgtagcttcatcaccgtatccacatcagaagtacaatgtccacttaatacatatatacacatatgtacgtatacacatatacacatgtgtacatatgtatgtatacacatgcacatgtgtacgtatgtatgtatacacatacatatatgtgtacacatatacatatgtatgtatacacatagatatatgtgtacacataaacatatgtatgtatacacataaacatgtatgtatacacatacatatatgtgtacacatatacttatgtatgtatacacatacatatatgtgtacacatatacttatgtatgtatacacatacatatatgtgtacacatatacttatgtatgtatacacatacatatatgtgtacacatatacacatatacatatatgtgtacacataaatatgtatgtatccatatatgtatatatatacacatgtatacagatatgcatctatatgtatacctctatatgtatgcacatatacatatatgtatacatatatacatatatgcatacatctataatatatgtatgtgtatatatacacatacagtgtccacttaatatatatatctatcttgtgtgtatgtgtgtgtaaatatacacacacatacacacacgataaaatacagagtctaccacatgatgagcctctgctaggtccttagcaatcaaaccacatgtccagtcctggcccccattctacaactaaacacatgggccagtttaggggtccaggagggcaagaatggtgggtccacgtagaaaccaggtgagggaggagcagtccacagggctggggtgatgggctggtgaagcagtgttccaggaggggaactgctgctcacagggctgtcctggtcgccctcgggatacagccagacttgatccgagtggctcccggggctgaatggggaccgccgggtgcatatcccaggaggcagccttcagctcagtggggaaagcagtttccaaccttagagctgcccaacactagcacagggcacctgagaaaggaggggcccctctgcctttactctgtctcccactagaggcagctggttccttcagggaactctggtggggggtgagggggtggctggttctcagtgggcaggggtgaccctactggggtcagtgggctggcaatgctggtcttcactaagaagagttgaaaatagccaggaagctaagccctggctcctgggctcctgggcagatgcttaattaggaggaagaaggaaccaaaatcatgaacacaactggctctctcagggggaggctgtcaccctccaagctcttcttccccttcctcaaatggagattcacactcatccctagttcaggagagccgccattgatgatgaggaaatccgtgtcaaagaagctggaaagactgctattcattgtgagaattttgtttccactgctacattacattgtttcttcttgttttcccttccaatttccagttaagaatctttcacagaaaatttttaattttatcacaaactgcacagatatcacacagctgcacccccatttggtgacacaaagcatacccttctgtgaagattttcactttacgccaaggcatgattgtcactttacgccaaggcaataaatttttacaaattttgtataacaggagctgaattctgggttctcaaatgtgaaatgtggcaaaaaaaaaaaaaaaaaaaaaaaagatttaattcaagcattttgtcatgtggttcttatttcttcaaccaagtttgtttacagtcactgcctttgaaatacagtcaaatacatctgtttgcttc

SEQ ID NO: 166190 - DNA, 1569 bp, Homo sapiens
  Payload ID: 12716
  Gene Symbol: PGBD5
  Gene Name: piggyBac transposable element derived 5
  Uniprot ID: Q8N414
  ENST ID: ENST00000525115
  CDS Start-End: 25-1392
gggcacctgttcggtaggtcagatatgcctgactacagaactcgagctctcttcgtgcaaagtactctcggggactctgcaggacctgagctgcagttgctcagcatagtgcccggccgggatctgcagccaagcgattcattcacaggtcccacccgaaagatgccccccagcgccagtgccgtggacttcttccagctctttgtcccagacaacgtcctcaagaacatggtggtgcagacaaacatgtatgccaagaagttccaggagcggtttgggagcgacggagcctgggtggaggtgacgctgacggagatgaaggcgttcctgggctacatgatctccaccagcatctcccactgcgagtccgtcctcagcatctggagcggaggcttctacagcaaccgcagcctcgccctcgtcatgagccaggcccgcttcgagaagatcctcaagtacttccacgtcgtggccttccgctccagccagaccacgcacgggctctacaaggtccagcccttcctcgactccctgcagaacagcttcgactctgccttcaggccttcccaaacccaggtgctacatgaacccctgatcgatgaggatcctgtattcattgccacgtgcacagagcgggagctgcgaaagaggaaaaagcggaaattcagcctctgggtcagacaatgttcttccactggcttcatcatccagatttatgtccacctgaaggaaggtgggggcccagatggcctggatgcgctgaagaataagccccagctccacagcatggtggccaggagcctgtgccggaacgcggcaggcaagaactacatcattttcacggggcccagcatcaccagcctgacgctgtttgaagagtttgagaagcaagggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctca

SEQ ID NO: 166191 - DNA, 1361 bp, Homo sapiens
  Payload ID: 12717
  Gene Symbol: PYURF
  Gene Name: PIGY upstream reading frame
  Uniprot ID: Q96I23
  ENST ID: ENST00000273968
  CDS Start-End: 114-458
tcctggaggaccagggggcggggcctgcccggctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtaggtgcctgcacgcgtcggggtcgcggcctttggccgaccggggcaagaagactgaggagccgccccgcgacttcgatccggcgctgctggagttcctggtgtgcccgctctccaagaagccgctcagatatgaagcatcaacaaacgaattgattaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaataaaccagtttgcagta

SEQ ID NO: 166192 - DNA, 1192 bp, Homo sapiens
  Payload ID: 12718
  Gene Symbol: PIH1D1
  Gene Name: PIH1 domain containing 1
  Uniprot ID: Q9NWS0
  ENST ID: ENST00000262265
  CDS Start-End: 237-1109
acagttcggcacgtaggacggagggtagtgcgtctagagacacatattccccacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggaatggggctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166193 - DNA, 833 bp, Homo sapiens
  Payload ID: 12718
  Gene Symbol: PIH1D1
  Gene Name: PIH1 domain containing 1
  ENST ID: ENST00000599366
  CDS Start-End: 125-833
gggactccccgcgaaaaaccgggcgcccaggcctggggaacgcagcgagcagcgccggccgggcagactctcaccagtgcgcatgcgtggctctccggcaccggtccgtactccagcgagggccatggcgaacccgaagctgctgggaatggggctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaagtcagtgccctcagaggacccaggagtctggcccgctaggccccttcttccctagaacccaagaatcctgggcccaggaccctcctccctcagctcctggagatctggcccctcgatctgattcttttccctatgaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctggggg

SEQ ID NO: 166194 - DNA, 998 bp, Homo sapiens
  Payload ID: 12718
  Gene Symbol: PIH1D1
  Gene Name: PIH1 domain containing 1
  ENST ID: ENST00000601807
  CDS Start-End: 178-998
ggacgcctagatctctttcccagggccatggcgaacccgaagctgctgggaatggggctaagcgaggcggaggcgatcggtgctgattcggcgcgatttgaggagctgctgctgcaggtgcagtgaccggacccctggatccttgagtattcggggattttggcggggtgctcaaagatgggactgcagttcccagaatgcactaaggcgggaaccaggcctcggggaattgaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgct

SEQ ID NO: 166195 - DNA, 874 bp, Homo sapiens
  Payload ID: 12718
  Gene Symbol: PIH1D1
  Gene Name: PIH1 domain containing 1
  ENST ID: ENST00000597415
  CDS Start-End: 383-874
acgggactccccgcgaaaaaccgggcgcccaggcctggggaacgcagcgagcagcgccggccgggcagactctcaccagtgcgcatgcgtggctctccggcaccggtccgtactccagcgaggtgaagatctcgcgggcgcggggccctgcacgcgtcgcagccatcgcctaccccgaacgctttccgcgaagactgcggggcgctctgtgttaaggggaaccttgagggccatggcgaacccgaagctgctgggaatggggctaagcgaggcggaggcgatcggtgctgattcggcgcgatttgaggagctgctgctgcaggtgcagtgaccggacccctggatccttgagtattcggggattttggcggggtgctcaaagatgggactgcagttcccagaatgcactaaggcgggaaccaggcctcggggaattgaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcg

SEQ ID NO: 166196 - DNA, 489 bp, Homo sapiens
  Payload ID: 12718
  Gene Symbol: PIH1D1
  Gene Name: PIH1 domain containing 1
  ENST ID: ENST00000594845
  CDS Start-End: 1-164
aaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccgggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166197 - DNA, 992 bp, Homo sapiens
  Payload ID: 12718
  Gene Symbol: PIH1D1
  Gene Name: PIH1 domain containing 1
  Uniprot ID: Q9NWS0
  ENST ID: ENST00000596049
  CDS Start-End: 107-979
ggactccccgcgaaaaaccgggcgcccaggcctggggaacgcagcgagcagcgccggccgggcagactctcaccagtgcgcatgcgtggctctccggcaccgggccatggcgaacccgaagctgctgggaatggggctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctcc

SEQ ID NO: 166198 - DNA, 741 bp, Homo sapiens
  Payload ID: 12718
  Gene Symbol: PIH1D1
  Gene Name: PIH1 domain containing 1
  ENST ID: ENST00000596651
  CDS Start-End: 1-390
aagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166199 - DNA, 418 bp, Homo sapiens
  Payload ID: 12718
  Gene Symbol: PIH1D1
  Gene Name: PIH1 domain containing 1
  ENST ID: ENST00000598175
  CDS Start-End: 1-166
gaggatgcagaacagcgatttcttgcgggagctcgtgatcaccatcgccagggagggccttgaggacaaatacaacttgcagctgaatccggaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactgatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166200 - DNA, 615 bp, Homo sapiens
  Payload ID: 12718
  Gene Symbol: PIH1D1
  Gene Name: PIH1 domain containing 1
  ENST ID: ENST00000598889
  CDS Start-End: 1-264
cgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166201 - DNA, 381 bp, Homo sapiens
  Payload ID: 12718
  Gene Symbol: PIH1D1
  Gene Name: PIH1 domain containing 1
  ENST ID: ENST00000601825
  CDS Start-End: 136-381
gactccccgcgaaaaaccgggcgcccaggcctggggaacgcagcgagcagcgccggccgggcagactctcaccagtgcgcatgcgtggctctccggcaccggtccgtactccagcgagatctctttcccagggccatggcgaacccgaagctgctgggaatggggctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgacc

SEQ ID NO: 166202 - DNA, 793 bp, Homo sapiens
  Payload ID: 12718
  Gene Symbol: PIH1D1
  Gene Name: PIH1 domain containing 1
  ENST ID: ENST00000596916
  CDS Start-End: 1-288
ctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgcctttg

SEQ ID NO: 166203 - DNA, 583 bp, Homo sapiens
  Payload ID: 12718
  Gene Symbol: PIH1D1
  Gene Name: PIH1 domain containing 1
  ENST ID: ENST00000595550
  CDS Start-End: 478-583
ataccagcttgtgaatgaacactggggtactcggaagtgtggcatactccagtcctgtgtttaccgatagaccggaagtgtggcttcgtttacagttcggcacgtaggacggagggtagtgcgtctagagacacatattccccacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggaatggggctaagcgaggcggaggcgatcggtgctgattcggcgcgatttgaggagctgctgctgcaggtgcagtgaccggacccctggatccttgagtattcggggattttggcggggtgctcaaagatgggactgcagttcccagaatgcactaaggcgggaaccaggcctcggggaattgagctctcatgcataagaattgctccatttgaggaacaaatgaggggtctga

SEQ ID NO: 166204 - DNA, 698 bp, Homo sapiens
  Payload ID: 12718
  Gene Symbol: PIH1D1
  Gene Name: PIH1 domain containing 1
  ENST ID: ENST00000597577
  CDS Start-End: 1-344
acgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactgacccttcaaatatagtttcccagcgtgtgaggctaccatgcctggtccaggtgatcatcctgttgctggggagggtgacctgattccgccacctctccaggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166205 - DNA, 633 bp, Homo sapiens
  Payload ID: 12718
  Gene Symbol: PIH1D1
  Gene Name: PIH1 domain containing 1
  ENST ID: ENST00000600875
  CDS Start-End: 1-550
ccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactgatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgccttt

SEQ ID NO: 166206 - DNA, 634 bp, Homo sapiens
  Payload ID: 12718
  Gene Symbol: PIH1D1
  Gene Name: PIH1 domain containing 1
  ENST ID: ENST00000601053
  CDS Start-End: 1-346
ggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactgacccttcaaatatagtttcccagcgtgtgaggctaccatgcctggtccaggtg

SEQ ID NO: 166207 - DNA, 1241 bp, Homo sapiens
  Payload ID: 12719
  Gene Symbol: PIH1D2
  Gene Name: PIH1 domain containing 2
  Uniprot ID: Q8WWB5
  ENST ID: ENST00000280350
  CDS Start-End: 224-1171
cgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggct

SEQ ID NO: 166208 - DNA, 1245 bp, Homo sapiens
  Payload ID: 12719
  Gene Symbol: PIH1D2
  Gene Name: PIH1 domain containing 2
  Uniprot ID: Q8WWB5
  ENST ID: ENST00000431456
  CDS Start-End: 224-1090
cgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgagggaacaacagaaccacaagcattagcgaaagatgaattatctttgaagttttgaatgtttgaaccagatttggatcatattgatgatggtcccttgtgataagcttgtttcttttggataatcttcaacctaaaattactaattactgaaaaatcaaattaatgtattgttttcataataatacagcaaggtaaaagtctgtgtggaat

SEQ ID NO: 166209 - DNA, 1838 bp, Homo sapiens
  Payload ID: 12719
  Gene Symbol: PIH1D2
  Gene Name: PIH1 domain containing 2
  Uniprot ID: Q8WWB5
  ENST ID: ENST00000530641
  CDS Start-End: 327-1148
aagtcgtgctcctgagaaatcgtcccaccaacaggcagcccagagactcccacaagggagggttttcaggacactccagaggttgacgggtgcagaaggaaggcgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggtaagttgaatagataacactgtaaatttgtattggccagcattcactaacatatattatgccacagtaacaaactacataatttcaggggcttacaatgatttgctcaggttacccggtgaaggagcaattcccttctgagatgtgccattcacatctcagcaaagggaaaatagaatgatcaaaccatgcagtggatcgtaatacttctactcagacatgacacttcatgatatcacttctactcacgctccactggccaaagtaagtcacaaggccagttctacatcagtaggactgagaagtgtattctcacagtcacaggaagtcatatggcagggtaaacgtactatcctcttacagaagagcaaatagttagagtcagtcctacagtctaccagtctacactcttggttgcaaatatttgcttctttctggaaggaaaacacctccaatcccagtatcagactccaaaggacagaattttgctttctcttcctcttgaaccatggactaagacatgtaaaaaaagttatgtactccctcagtcccatctgtcatgcaatgtggaatggggagaagataaccgtaattaaccatctcaattcagaaatgggaaaaataagaggcacactgcagttactggtgcacagcaattctgaaatcctagtaggcagacattgtgagggctccttttct

SEQ ID NO: 166210 - DNA, 755 bp, Homo sapiens
  Payload ID: 12719
  Gene Symbol: PIH1D2
  Gene Name: PIH1 domain containing 2
  ENST ID: ENST00000525072
  CDS Start-End: 1-755
gggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatga

SEQ ID NO: 166211 - DNA, 1103 bp, Homo sapiens
  Payload ID: 12719
  Gene Symbol: PIH1D2
  Gene Name: PIH1 domain containing 2
  Uniprot ID: Q8WWB5
  ENST ID: ENST00000532211
  CDS Start-End: 83-1030
ggtgggtttgccaacctatagaatgattacccgttagaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggctaaa

SEQ ID NO: 166212 - DNA, 487 bp, Homo sapiens
  Payload ID: 12719
  Gene Symbol: PIH1D2
  Gene Name: PIH1 domain containing 2
  ENST ID: ENST00000525744
  CDS Start-End: 1-487
cagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaaggggtaagttgatgattgtaaatggaaaattaaactgctttaagatgt

SEQ ID NO: 166213 - DNA, 1025 bp, Homo sapiens
  Payload ID: 12719
  Gene Symbol: PIH1D2
  Gene Name: PIH1 domain containing 2
  Uniprot ID: Q8WWB5
  ENST ID: ENST00000528775
  CDS Start-End: 1-867
atggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgagggaacaacagaaccacaagcattagcgaaagatgaattatctttgaagttttgaatgtttgaaccagatttggatcatattgatgatggtcccttgtgataagcttgtttcttttggataatcttcaacctaaaattactaattactgaaaaatcaaattaatgtattgttttcataataatacagcaaggtaaaagtctgtgtggaatata

SEQ ID NO: 166214 - DNA, 993 bp, Homo sapiens
  Payload ID: 12720
  Gene Symbol: PIH1D3
  Gene Name: PIH1 domain containing 3
  Uniprot ID: Q9NQM4
  ENST ID: ENST00000336387
  CDS Start-End: 283-927
gcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaa

SEQ ID NO: 166215 - DNA, 1652 bp, Homo sapiens
  Payload ID: 12720
  Gene Symbol: PIH1D3
  Gene Name: PIH1 domain containing 3
  Uniprot ID: Q9NQM4
  ENST ID: ENST00000372453
  CDS Start-End: 63-707
cgccacgctctgcacagtctattttcggagcctagccagagacgggaaaactgaccaagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattta

SEQ ID NO: 166216 - DNA, 1926 bp, Homo sapiens
  Payload ID: 12720
  Gene Symbol: PIH1D3
  Gene Name: PIH1 domain containing 3
  Uniprot ID: Q9NQM4
  ENST ID: ENST00000535523
  CDS Start-End: 338-982
cgccacgctctgcacagtctattttcggagcctagccagagacgggaaaactgaccaaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattt

SEQ ID NO: 166217 - DNA, 2323 bp, Homo sapiens
  Payload ID: 12721
  Gene Symbol: PIANP
  Gene Name: PILR alpha associated neural protein
  Uniprot ID: Q8IYJ0
  ENST ID: ENST00000320591
  CDS Start-End: 231-1079
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 166218 - DNA, 290 bp, Homo sapiens
  Payload ID: 12721
  Gene Symbol: PIANP
  Gene Name: PILR alpha associated neural protein
  ENST ID: ENST00000536467
  CDS Start-End: 61-290
agactccctccctagcgtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacg

SEQ ID NO: 166219 - DNA, 2432 bp, Homo sapiens
  Payload ID: 12721
  Gene Symbol: PIANP
  Gene Name: PILR alpha associated neural protein
  Uniprot ID: Q8IYJ0
  ENST ID: ENST00000540656
  CDS Start-End: 340-1188
ctccctggcgcagccgtccccgtccccgcggctgcctccatcccgcctcggctcggcgggcggctccgcgcagtctcctgcttcgggtccccagtccgctctcggcactccctgcctcggggtcccttcgccgacctccttttcctcgtctccccccactctcgccgctctccagccctgtgcggggagtgcgggcctgcgggatgggtgggatgggggccacgctggggctggggcccggctcccgcaccccgaggctcctgccccacccccagctcgtctcctgcgcacaacagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 166220 - DNA, 577 bp, Homo sapiens
  Payload ID: 12721
  Gene Symbol: PIANP
  Gene Name: PILR alpha associated neural protein
  ENST ID: ENST00000542740
  CDS Start-End: 246-577
agatggggctggagtctggtcaggcaaccacgctggagtttttcccccaaaaggatgctaacaaccagtgaatcctgggtgcagccgcatagctggcagctgggtggcctgggagggcagatgcgggtagaattggtggatgaattagctggggaagtacacagggcagggctggggtgtgacggccccctttttctcccagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccac

SEQ ID NO: 166221 - DNA, 2695 bp, Homo sapiens
  Payload ID: 12721
  Gene Symbol: PIANP
  Gene Name: PILR alpha associated neural protein
  Uniprot ID: Q8IYJ0
  ENST ID: ENST00000534837
  CDS Start-End: 231-1061
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagat

SEQ ID NO: 166222 - DNA, 614 bp, Homo sapiens
  Payload ID: 12721
  Gene Symbol: PIANP
  Gene Name: PILR alpha associated neural protein
  ENST ID: ENST00000545917
  CDS Start-End: 100-614
agtcctagagtcagctggccacagatgcgccctgggagcccttctccgcttcactgtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccg

SEQ ID NO: 166223 - DNA, 2650 bp, Homo sapiens
  Payload ID: 12722
  Gene Symbol: PIM1
  Gene Name: Pim-1 proto-oncogene, serine/threonine kinase
  Uniprot ID: P11309
  ENST ID: ENST00000373509
  CDS Start-End: 374-1315
gaggaggcccgagaggagtcggtggcagcggcggcggcgggaccggcagcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtctt

SEQ ID NO: 166224 - DNA, 2075 bp, Homo sapiens
  Payload ID: 12723
  Gene Symbol: PIM2
  Gene Name: Pim-2 proto-oncogene, serine/threonine kinase
  Uniprot ID: Q9P1W9
  ENST ID: ENST00000376509
  CDS Start-End: 191-1126
agtagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttcttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaa

SEQ ID NO: 166225 - DNA, 892 bp, Homo sapiens
  Payload ID: 12723
  Gene Symbol: PIM2
  Gene Name: Pim-2 proto-oncogene, serine/threonine kinase
  ENST ID: ENST00000442430
  CDS Start-End: 458-892
ttgaactcttgggctcaagcaatccacccacatcagcctcccaaagtgctgggattgcagggatgagccactgtgcctggccgaacttctttcgtttattcaaatgtttattgatctacgacatgcgagatttgtgcaggctctttgctggtttcaccctctcaatcgctgtgtgagtttgtgtctttagggaaagtgaggcccaggaagggaagtgagttgcttagcgacacactgtcaggaaaaggggccctgagttgagcttaggtaaaaagcctcagagctgttgccctgacatctgtcttttttctctccctgcttcccaccccacctgtgcccccagtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctcccca

SEQ ID NO: 166226 - DNA, 2369 bp, Homo sapiens
  Payload ID: 12724
  Gene Symbol: PIM3
  Gene Name: Pim-3 proto-oncogene, serine/threonine kinase
  Uniprot ID: Q86V86
  ENST ID: ENST00000360612
  CDS Start-End: 436-1416
agcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgtcccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttctcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacatagtggataa

SEQ ID NO: 166227 - DNA, 1545 bp, Homo sapiens
  Payload ID: 12725
  Gene Symbol: PINX1
  Gene Name: PIN2/TERF1 interacting, telomerase inhibitor 1
  Uniprot ID: Q96BK5
  ENST ID: ENST00000314787
  CDS Start-End: 121-1107
cgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggaaggatctgtcatctcggagcaaaacagatcttgactgcatttttgggaaaagacagagtaagaagactcccgagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctgagcccttcagcaagagagtttaattataatcattacaaatacatgcattcatgtaagtgtgcacacgtgtgtgtgcatgtgcgcatctgtgtgtgtgtgtgtgtgtcactatctccgtttgctctcggttcccttcaataacaatgaatggtgctttcttctgaaagactcagcctaattaaaggattaagaggcaa

SEQ ID NO: 166228 - DNA, 778 bp, Homo sapiens
  Payload ID: 12725
  Gene Symbol: PINX1
  Gene Name: PIN2/TERF1 interacting, telomerase inhibitor 1
  ENST ID: ENST00000523559
  CDS Start-End: 121-525
cgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagtttattgttgaagtcaccttggattccttgtcttacagaatttcccatgtcctgaattttgttgatttcaccttcccagtgggctttaatgtattcacttcgtaaagagaccgtacactgactcactttaaccacatagattaccatccctgctgaatccacatttatccttaatttcccttgtgtggctttttaccaaaagggcgatgccagtccctccactccagaggagaacgaaaccacgacaaccagcgccttcaccat

SEQ ID NO: 166229 - DNA, 610 bp, Homo sapiens
  Payload ID: 12725
  Gene Symbol: PINX1
  Gene Name: PIN2/TERF1 interacting, telomerase inhibitor 1
  ENST ID: ENST00000524114
  CDS Start-End: 16-610
cacaggctctccgacatgtctatgctggctgaacgtgagtgtcggaagcggaggcccgacccaggtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggaaggatctgtcatctcggagcaaaacagatcttgactgcatttttgggaaaagacagagtaagaagactcccgagggcgatgccagtccctccactccagaggagaacgaaaccacgacaaccagcgccttcaccatccaggagtactttgccaagcggatggcagcac

SEQ ID NO: 166230 - DNA, 1272 bp, Homo sapiens
  Payload ID: 12725
  Gene Symbol: PINX1
  Gene Name: PIN2/TERF1 interacting, telomerase inhibitor 1
  Uniprot ID: Q96BK5
  ENST ID: ENST00000519088
  CDS Start-End: 121-645
cgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctga

SEQ ID NO: 166231 - DNA, 440 bp, Homo sapiens
  Payload ID: 12725
  Gene Symbol: PINX1
  Gene Name: PIN2/TERF1 interacting, telomerase inhibitor 1
  ENST ID: ENST00000524061
  CDS Start-End: 1-59
atatgaaattcacaaaaggaagaacagtcttactgaaaagcatcacattgtttttctagggaaggatctgtcatctcggagcaaaacagatcttgactgcatttttgggaaaagacagagtaagaagactcccgagtttattgttgaagtcaccttggattccttgtcttacagaatttcccatgtcctgaattttgttgatttcaccttcccagtgggctttaatgtattcacttcgtaaagagaccgtacactgactcactttaaccacatagattaccatccctgctgaatccacatttatccttaatttcccttgtgtggctttttaccaaaaggtaaatggttcttgccatcacatagcttacagtgtaatctgaaagataataatattgtaaactctttcaaaatactaatgtcaaatagaagatatgtcagcc

SEQ ID NO: 166232 - DNA, 3576 bp, Homo sapiens
  Payload ID: 12726
  Gene Symbol: PNN
  Gene Name: pinin, desmosome associated protein
  Uniprot ID: Q9H307
  ENST ID: ENST00000216832
  CDS Start-End: 68-2221
cgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaaaccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttctttgagtttaacactgtagctttagccttgactttgaatattcattttgccttcccttgacaagtaaatggttacagtgaaaatgtgaagaagtatttccagttagtttttgtgtgtatataactcacttgtgtaagtggatgtgttaaaagatctctttttaaaaatccttttattggagtaattattaaaacagtaaatgca

SEQ ID NO: 166233 - DNA, 656 bp, Homo sapiens
  Payload ID: 12726
  Gene Symbol: PNN
  Gene Name: pinin, desmosome associated protein
  ENST ID: ENST00000553331
  CDS Start-End: 98-472
attggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctg

SEQ ID NO: 166234 - DNA, 601 bp, Homo sapiens
  Payload ID: 12726
  Gene Symbol: PNN
  Gene Name: pinin, desmosome associated protein
  ENST ID: ENST00000556530
  CDS Start-End: 51-404
atagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaaggtattgagattgaaagaacttaaatgaatgtagtaccttcactttactacatttaaaagcacaccactcatatgctagttaaattactgagattttctttttctgcagccagcattgcagtcttcagttgtagctacctccaaagagcgcacacgtagagaccttatccaggatcaaaatatggatgaaaagggaaagcaaaggtatttccctgggggaaaaaa

SEQ ID NO: 166235 - DNA, 2414 bp, Homo sapiens
  Payload ID: 12727
  Gene Symbol: PIPOX
  Gene Name: pipecolic acid oxidase
  Uniprot ID: Q9P0Z9
  ENST ID: ENST00000323372
  CDS Start-End: 327-1499
gagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataaataactgccctgcattaa

SEQ ID NO: 166236 - DNA, 760 bp, Homo sapiens
  Payload ID: 12727
  Gene Symbol: PIPOX
  Gene Name: pipecolic acid oxidase
  ENST ID: ENST00000469082
  CDS Start-End: 147-760
gggctggagtagttgaactggaaggttttttctaattttgcttctttgtgaatctaagtgagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcag

SEQ ID NO: 166237 - DNA, 720 bp, Homo sapiens
  Payload ID: 12727
  Gene Symbol: PIPOX
  Gene Name: pipecolic acid oxidase
  ENST ID: ENST00000466889
  CDS Start-End: 262-720
gtcagcatcagtttccttgttcataaaatgaaggggctggagtagttgaactggaaggttttttctaattttgcttctttgtgaatctaagtgaggtgagattgcagcaggatggttgaagactagctaacaaaagaacttctggatgtgaacaacgttagcaaaaaggaagcctaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctc

SEQ ID NO: 166238 - DNA, 1282 bp, Homo sapiens
  Payload ID: 12728
  Gene Symbol: PIR
  Gene Name: pirin (iron-binding nuclear protein)
  Uniprot ID: O00625
  ENST ID: ENST00000380420
  CDS Start-End: 205-1077
cctcccgcctcctctaggccgccggccgcgaagcgctgagtcacggtgaggctactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaa

SEQ ID NO: 166239 - DNA, 1539 bp, Homo sapiens
  Payload ID: 12728
  Gene Symbol: PIR
  Gene Name: pirin (iron-binding nuclear protein)
  Uniprot ID: O00625
  ENST ID: ENST00000380421
  CDS Start-End: 462-1334
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggctactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaa

SEQ ID NO: 166240 - DNA, 1603 bp, Homo sapiens
  Payload ID: 12729
  Gene Symbol: PITHD1
  Gene Name: PITH (C-terminal proteasome-interacting domain of thioredoxin-like) domain containing 1
  Uniprot ID: Q9GZP4
  ENST ID: ENST00000246151
  CDS Start-End: 112-747
gcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatgggtaacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 166241 - DNA, 1292 bp, Homo sapiens
  Payload ID: 12729
  Gene Symbol: PITHD1
  Gene Name: PITH (C-terminal proteasome-interacting domain of thioredoxin-like) domain containing 1
  ENST ID: ENST00000374524
  CDS Start-End: 140-436
tggattaaagatatttgtaggctagacgcggtggctcatgcctgtaattccagcactttcggagaccgacgtaggcggatcacctgaggttgggagttagagaccagcattgccaacatggtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatgggtaacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 166242 - DNA, 754 bp, Homo sapiens
  Payload ID: 12729
  Gene Symbol: PITHD1
  Gene Name: PITH (C-terminal proteasome-interacting domain of thioredoxin-like) domain containing 1
  ENST ID: ENST00000415372
  CDS Start-End: 545-754
agcagggtgggagatgcctgaaattgtaggctctcagcaaatatttgttgctttctcctcccccctccccatcccctccagtttgttgaaagtgatgcagatgaagagcttctgtttaatattccgtaagtatctccttggtgcctacctcaggctaaataggctgtacccagttgcctcagatggattcattcactggtgtcaagagcacacatttgcttctagaaatgggataaattactttggtgggtttgaggaggaaagcatcatagctttcttggtgcagactggaaacagatgtatttgtagaacaataactgagaaattgaggtagatttcttagaattgtagaatgctagaggtagacaggatcttagaaattatctagtacaagttgacagatgagtaaactgaagcccatacaggggaagggtcttgcccagggtcacacaactaaacaggtattcaaactcaggtttgacaaccttctcttttgcattctggcagatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagat

SEQ ID NO: 166243 - DNA, 7086 bp, Homo sapiens
  Payload ID: 12730
  Gene Symbol: PITPNM3
  Gene Name: PITPNM family member 3
  Uniprot ID: Q9BZ71
  ENST ID: ENST00000262483
  CDS Start-End: 89-3013
gagtccgttcggggccggaggcggtcggggccgggcccgggaagcgcgaggagcgcgcgtagcgccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagagaggagatggctgaagggaagaatgccatcctcattgggatgagccagtggaactccaatgacctcgtggagcagatcgagaccatggggaaactggacgagcatcaaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttacgccgtctctgtccacagccctcgggggtggggtctggtgctgacggtctgtcctgcagctgtccattgtccccaacccccgttgtcctcagtgtcctcaccatttccctgtggccctggaggccagggcttcctcttcccggagccctgcctcatgccctcccttgggaggctgcagccttgggctctggctcagctgggctggctgtgagcccctgagctggttgcttgccctctctgggctccgtcttccttctgttattggaggggtccccctagctgagattggtgtgagtctttgactcccaagatgtcctgcagtttggcccattgaggctcttcaggcctaagggtccctccgagtgtcctgtgacccacacctttcacacagcctgggagagggggtctgggtgggctggaaaggaggggctcttaaaggagcctctctgggtgggctgggaagggatccctactccacggagaggtgcagctggtttgccttgcactgcgtgtcccagggacaacccactcaaactgggtgtcctagggacaacccacctccctctcctgccaaaaggttactgattgggctccccataaccccagctctgccaggacccttttatcctttttggctcccagaggcatagagctgagattccagggttctaggggttcctggaagtttggctccaactgttgtattctcttccctttcccctgctgctcagtttgtgcccataacctcctcctgggtagtcccctgaggttggcaggacttggcccttctggggcccctaaagcctgctcaggccctcctgctgctgaaccttggcctgggcactgctttcctgcatcctggaaaaccccgactccctggcccaggcccacacctgctgtgtggggctgcccacgtggccactgagcccccataggctgccatcaaggccggtcccagcaatttcagccaggctgccccagggcccagacgtctgtatacacagcaggcacctgtgtcagctcagtgtcgcttctgctcaatgtctacctctcgcggctcccatgcagccagtgacgctgctggtgggggcggctggcaccgccgttgtgaattgcctggcaaattgggtgccctcctggggctggaggggtctgggctcctaacccccatccctgctctccccactagaaatgtgtcttcagtctgccagctcttctgctctacttccagtgctgcatcctgcactcaagcccagggctgctggcgagtctatggggaggagtgcggatcaggctcagcctcagcctcagcctcagcctcctctatggtcctgtctcctggcggttcacaggtgcccatcccccctttaacatttcacagttcttggctttccaaaggcaccagctcatatggcatagccaccccaaccctaatccttcccccaaatatcctgatttaaacttgggcagacttagtctgattcttgaaaactctaccatctccttcttgcagaaggcactggttacactaaaatgataaaataattagtatggggtactttgctcccagttacattccctcttccctgagaaccccaggctaggcgagagagggagagggagagagaaagagagagagggagagagagagagagagagggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcggggggggggggtttgggtgccaagtgccctggaaacctattgtcttttggctcagccaaaagaaacattccctccttcctttccttccgggcttgggggaaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctt

SEQ ID NO: 166244 - DNA, 6945 bp, Homo sapiens
  Payload ID: 12730
  Gene Symbol: PITPNM3
  Gene Name: PITPNM family member 3
  Uniprot ID: Q9BZ71
  ENST ID: ENST00000421306
  CDS Start-End: 55-2871
gcccgggaagcgcgaggagcgcgcgtagcgccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttacgccgtctctgtccacagccctcgggggtggggtctggtgctgacggtctgtcctgcagctgtccattgtccccaacccccgttgtcctcagtgtcctcaccatttccctgtggccctggaggccagggcttcctcttcccggagccctgcctcatgccctcccttgggaggctgcagccttgggctctggctcagctgggctggctgtgagcccctgagctggttgcttgccctctctgggctccgtcttccttctgttattggaggggtccccctagctgagattggtgtgagtctttgactcccaagatgtcctgcagtttggcccattgaggctcttcaggcctaagggtccctccgagtgtcctgtgacccacacctttcacacagcctgggagagggggtctgggtgggctggaaaggaggggctcttaaaggagcctctctgggtgggctgggaagggatccctactccacggagaggtgcagctggtttgccttgcactgcgtgtcccagggacaacccactcaaactgggtgtcctagggacaacccacctccctctcctgccaaaaggttactgattgggctccccataaccccagctctgccaggacccttttatcctttttggctcccagaggcatagagctgagattccagggttctaggggttcctggaagtttggctccaactgttgtattctcttccctttcccctgctgctcagtttgtgcccataacctcctcctgggtagtcccctgaggttggcaggacttggcccttctggggcccctaaagcctgctcaggccctcctgctgctgaaccttggcctgggcactgctttcctgcatcctggaaaaccccgactccctggcccaggcccacacctgctgtgtggggctgcccacgtggccactgagcccccataggctgccatcaaggccggtcccagcaatttcagccaggctgccccagggcccagacgtctgtatacacagcaggcacctgtgtcagctcagtgtcgcttctgctcaatgtctacctctcgcggctcccatgcagccagtgacgctgctggtgggggcggctggcaccgccgttgtgaattgcctggcaaattgggtgccctcctggggctggaggggtctgggctcctaacccccatccctgctctccccactagaaatgtgtcttcagtctgccagctcttctgctctacttccagtgctgcatcctgcactcaagcccagggctgctggcgagtctatggggaggagtgcggatcaggctcagcctcagcctcagcctcagcctcctctatggtcctgtctcctggcggttcacaggtgcccatcccccctttaacatttcacagttcttggctttccaaaggcaccagctcatatggcatagccaccccaaccctaatccttcccccaaatatcctgatttaaacttgggcagacttagtctgattcttgaaaactctaccatctccttcttgcagaaggcactggttacactaaaatgataaaataattagtatggggtactttgctcccagttacattccctcttccctgagaaccccaggctaggcgagagagggagagggagagagaaagagagagagggagagagagagagagagagggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcggggggggggggtttgggtgccaagtgccctggaaacctattgtcttttggctcagccaaaagaaacattccctccttcctttccttccgggcttgggggaaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgccttt

SEQ ID NO: 166245 - DNA, 734 bp, Homo sapiens
  Payload ID: 12730
  Gene Symbol: PITPNM3
  Gene Name: PITPNM family member 3
  ENST ID: ENST00000575201
  CDS Start-End: 1-349
gggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagatgtgctttccatgaccgaagctatggttcccactagcagcaccaggaaactcggaaactcgggagaagtgcaaattatctgccctgcctcctcctgccaccctcttagacctactcaatcagaaactctggggaggggctcaggaaccttttcacaagccctccaggggattctgatgcacagaaagattaatcaagaatccctgacctagagcagaagaggcgttgacatataatgaccaaacccagcccacagcctgttttgatatgactggtcagctaagaatggtttttacactttcaaatggatggagagaataatcaaaagaatgatatttcatgacatgcaaattacatgaatttcaatgtctctaaataaaaaaagtttgattggaacaca

SEQ ID NO: 166246 - DNA, 3450 bp, Homo sapiens
  Payload ID: 12731
  Gene Symbol: PITRM1
  Gene Name: pitrilysin metallopeptidase 1
  Uniprot ID: Q5JRX3
  ENST ID: ENST00000224949
  CDS Start-End: 36-3149
ggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgactt

SEQ ID NO: 166247 - DNA, 3487 bp, Homo sapiens
  Payload ID: 12731
  Gene Symbol: PITRM1
  Gene Name: pitrilysin metallopeptidase 1
  Uniprot ID: Q5JRX3
  ENST ID: ENST00000380989
  CDS Start-End: 70-3186
aagccccgccccgcgccctgcgtcgggttaagagggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcaggtaggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgactt

SEQ ID NO: 166248 - DNA, 2579 bp, Homo sapiens
  Payload ID: 12731
  Gene Symbol: PITRM1
  Gene Name: pitrilysin metallopeptidase 1
  ENST ID: ENST00000380994
  CDS Start-End: 495-2282
tgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaactggctttttgatatttttatgtgaaatagattactttaaatgggtaagggtttataactagtaatctgttggttatttcctaaacattatttcagcctgtgctttttattttattggaacaaaacagggctaaagtaagtttttttgtttctccatccaaagaattacatgacttttgttataaacaatcatctgtggtatatttaaatacagaaactaggattttagtatcaagtctgggctgttggtggaggttgtactgtggtaccagctgcattgtggatgtggaaatcttccttccagtacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctg

SEQ ID NO: 166249 - DNA, 718 bp, Homo sapiens
  Payload ID: 12731
  Gene Symbol: PITRM1
  Gene Name: pitrilysin metallopeptidase 1
  ENST ID: ENST00000430362
  CDS Start-End: 1-700
cttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacaggtcactgtgaacgctacgcttttcccgggtctcgggttccttgggggaattaaatgtcactcctcacagaa

SEQ ID NO: 166250 - DNA, 673 bp, Homo sapiens
  Payload ID: 12731
  Gene Symbol: PITRM1
  Gene Name: pitrilysin metallopeptidase 1
  ENST ID: ENST00000455371
  CDS Start-End: 1-555
aaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggtattttgagtataacagtgagaatctcaacccacagcctcacagatgacgttgctgttttccaagttcccggcatgcatgggcaggagcactagcttctggtgcctccatccttgcttgtgatacgatttccacgtctgacaccctaaacacgcttcctgacatccgggcgagaagagtgcatcctgtcatttgttttactgacctgagacc

SEQ ID NO: 166251 - DNA, 3183 bp, Homo sapiens
  Payload ID: 12731
  Gene Symbol: PITRM1
  Gene Name: pitrilysin metallopeptidase 1
  Uniprot ID: Q5JRX3
  ENST ID: ENST00000451104
  CDS Start-End: 63-2882
aagccccgccccgcgccctgcgtcgggttaagagggggttcctcgccagccaggtgctcgtcatgcgcaatgtggcgctgcggcgggcggcagggcctgtgtgtgctgaggcggctgagcggcgggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgactt

SEQ ID NO: 166252 - DNA, 482 bp, Homo sapiens
  Payload ID: 12731
  Gene Symbol: PITRM1
  Gene Name: pitrilysin metallopeptidase 1
  ENST ID: ENST00000424714
  CDS Start-End: 1-261
gtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatgtatacgttaaggcatcacgtcaagattggaggacttcatgtcagttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccct

SEQ ID NO: 166253 - DNA, 875 bp, Homo sapiens
  Payload ID: 12731
  Gene Symbol: PITRM1
  Gene Name: pitrilysin metallopeptidase 1
  ENST ID: ENST00000451454
  CDS Start-End: 1-778
tttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccaggaaaaggcctgtctgtggaagcggcgacctggggctgatctcaccacgggcgtcttcaaggagcctgtgtctgtgctgcagaccctcccatcattgtctgccccgccttctgtcggaggtggatgtgttctagaatcagcttgaatgtgatgttaccgttcacagtggaaggcagaggaaattggccctgttcctagaaatgtgctttatcagagagtgtgtgttttctt

SEQ ID NO: 166254 - DNA, 753 bp, Homo sapiens
  Payload ID: 12732
  Gene Symbol: PTTG1
  Gene Name: pituitary tumor-transforming 1
  Uniprot ID: O95997
  ENST ID: ENST00000352433
  CDS Start-End: 82-690
gtggtttaaaccaggagtgcgccgcgtccgttcaccgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagattctt

SEQ ID NO: 166255 - DNA, 1070 bp, Homo sapiens
  Payload ID: 12732
  Gene Symbol: PTTG1
  Gene Name: pituitary tumor-transforming 1
  Uniprot ID: O95997
  ENST ID: ENST00000393964
  CDS Start-End: 404-1012
cgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacaga

SEQ ID NO: 166256 - DNA, 895 bp, Homo sapiens
  Payload ID: 12732
  Gene Symbol: PTTG1
  Gene Name: pituitary tumor-transforming 1
  Uniprot ID: O95997
  ENST ID: ENST00000520452
  CDS Start-End: 264-872
gagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaaaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttg

SEQ ID NO: 166257 - DNA, 684 bp, Homo sapiens
  Payload ID: 12732
  Gene Symbol: PTTG1
  Gene Name: pituitary tumor-transforming 1
  ENST ID: ENST00000517480
  CDS Start-End: 321-684
gcggcctcagatgaatgcggctgttaagacctgcaataatccagaatggctactctgatctatgttgataaggaaaatggagaaccaggcacccgtgtggttgctaaggatgggctgaagctggggtctggaccttgtaagtatacaaggctgcagtcggatacactggtattgtggacgtggcctggagctggacgagacatttagtgtactttttgggcaattggagtcgtttgttattggtcctttttcatttttaatatcttaatgagatgatttaaggaagttactgaatctctgctattaggcctatcatagccatgccactaccaaaagtggggggtgggtttgggggtgagaggtcaagtttatatacacagtatttaagttgtacaggtattttgctgctggaatattcttatggtaagactttttcttcagcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatc

SEQ ID NO: 166258 - DNA, 2760 bp, Homo sapiens
  Payload ID: 12733
  Gene Symbol: PTTG1IP
  Gene Name: pituitary tumor-transforming 1 interacting protein
  Uniprot ID: P53801
  ENST ID: ENST00000330938
  CDS Start-End: 222-764
gcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagta

SEQ ID NO: 166259 - DNA, 755 bp, Homo sapiens
  Payload ID: 12733
  Gene Symbol: PTTG1IP
  Gene Name: pituitary tumor-transforming 1 interacting protein
  ENST ID: ENST00000397886
  CDS Start-End: 102-581
agtgcagttgtgaaggtcagaggtaggaagcatggtccttgctacagatggtgaccatgctcacccaagtccattcaacacaaactcagtgagtgcctgtgatgggccaggctgtgtcctgtgttcttgggagacttcagccagtgaagtgcacaggtgcccggcgtgtggggaggagaggtctacggaagcaaacctcacaggagtgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgca

SEQ ID NO: 166260 - DNA, 2413 bp, Homo sapiens
  Payload ID: 12733
  Gene Symbol: PTTG1IP
  Gene Name: pituitary tumor-transforming 1 interacting protein
  ENST ID: ENST00000397887
  CDS Start-End: 94-417
cacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttggggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagta

SEQ ID NO: 166261 - DNA, 2497 bp, Homo sapiens
  Payload ID: 12733
  Gene Symbol: PTTG1IP
  Gene Name: pituitary tumor-transforming 1 interacting protein
  ENST ID: ENST00000445724
  CDS Start-End: 288-716
atccgcgccgcgcaggcgcactgagcctcagccgctctcctcgctaccaggctcctttcctctatcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctccgcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagt

SEQ ID NO: 166262 - DNA, 691 bp, Homo sapiens
  Payload ID: 12734
  Gene Symbol: PTTG2
  Gene Name: pituitary tumor-transforming 2
  Uniprot ID: Q9NZH5
  ENST ID: ENST00000504686
  CDS Start-End: 1-576
atggctactctgatctacgttgataaggaaattggagaaccaggcacccgtgtggctgccaaggatgtgctgaagctggagtctagaccttcaatcaaagcattagatgggatatctcaagttttaacacgacgttttggcaaaacatacgatgctccatcagccttacctaaagctaccagaaaggctttgggcactgtcaacagagctacagaaaagtcagtaaagaccaatggacccagaaaacaaaaacagccaagcttttctgccaaaaagatgaccgagaagactgttaaaacaaaaagttctgttcctgcctcagatgacgcctatccagaaatagaaaaattctttcccttcaatcttctagactttgagagttttgacctgcctgaagagcgccagattgcacacctccccttgagtggagtgcctctcatgatccttgatgaggagggagagcttgaaaagctgtttcagctgggccccccttcacctgtgaaaatgccctctccaccatgggaatgcaatctgtttgcagtctccttcaagcattctgtcgaccctggatgttgaattgccagctgtttgctatgacatagatatttaaatttcttagtgctttggagtttgtgtgtacttgtattaataaagcattatttgtttaacaacataataaatacataaatat

SEQ ID NO: 166263 - DNA, 3897 bp, Homo sapiens
  Payload ID: 12735
  Gene Symbol: PIWIL1
  Gene Name: piwi-like RNA-mediated gene silencing 1
  Uniprot ID: Q96J94
  ENST ID: ENST00000245255
  CDS Start-End: 273-2858
gttactgggcgtatggcgtacagacacgaggccggcgcccgggaggcggtgttcatccgcccgggaaaagagcgcctgttgctcgctgcccgcgtgtccctggctctctcgggaacccagcgccgaaggcgaggtgggcgcgggccgaaggaggtcctgggaggtcggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatacgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttatttgaataactgtaattcttgttttactgaaagtatgtgcgttttcttttcatttaatttttaaaagtgcatacaattccattcataaaagctaaattagcctgaccaacatggtgaaaccccatctctactaaaaatacaaaattagccagatgtggtgccaggaggctgaggcaggagaatcacttgaacctgagaggcggaggttgcagtgagcagagatcacgccactgcactccagcctgggcaacagagtgagactccgtctcaaaaaaaaaaaaaaaaaaaaaaaaaaaaaaaaaaaaaaaa

SEQ ID NO: 166264 - DNA, 879 bp, Homo sapiens
  Payload ID: 12735
  Gene Symbol: PIWIL1
  Gene Name: piwi-like RNA-mediated gene silencing 1
  ENST ID: ENST00000542723
  CDS Start-End: 362-879
atctccaaatgggaaagaaagaaccagccaccagcatcctaattctttcagcactttctcctcctaagtctgtttataataaataatccaaatgaaaaactaagtcttatattaaaataggttttcccctttggccctactgcagtgcccagtgcaaggtaagcaactgagtttgttgaatgtaggaatgttacattaaaaaaaactgtcattaaagattagaaggatacataataattgcctggggagcttacttttgaaactcaaagaagtttaaagtaacattgtagaaattatcaaatgcgattgcctccattgagtattgtcttcaagattgtttcctctccagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaag

SEQ ID NO: 166265 - DNA, 545 bp, Homo sapiens
  Payload ID: 12735
  Gene Symbol: PIWIL1
  Gene Name: piwi-like RNA-mediated gene silencing 1
  ENST ID: ENST00000539995
  CDS Start-End: 95-545
gtgcacggcgtggtcctgagctcagcgccggagggacgttaggtggaagcgtctttggcagagctggtagcgaatcggagagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttcttt

SEQ ID NO: 166266 - DNA, 467 bp, Homo sapiens
  Payload ID: 12735
  Gene Symbol: PIWIL1
  Gene Name: piwi-like RNA-mediated gene silencing 1
  ENST ID: ENST00000539400
  CDS Start-End: 101-467
agcggtccaaggtgcggggccaggctgaggtgctaggtgtgcgggggccgggatgcgggggcggcggctgggggtccgggatgtggagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacat

SEQ ID NO: 166267 - DNA, 571 bp, Homo sapiens
  Payload ID: 12735
  Gene Symbol: PIWIL1
  Gene Name: piwi-like RNA-mediated gene silencing 1
  ENST ID: ENST00000546060
  CDS Start-End: 77-571
gtgcaaggaccaggactagggcgagggcagcggtccaaggtgcggggccaggctgaggtgctagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatgga

SEQ ID NO: 166268 - DNA, 566 bp, Homo sapiens
  Payload ID: 12735
  Gene Symbol: PIWIL1
  Gene Name: piwi-like RNA-mediated gene silencing 1
  ENST ID: ENST00000535956
  CDS Start-End: 215-566
gttaggtggaagcgtctttggcagagctggtagcgaatcggagaggtgatttccagcgagtgtggttattggaagcacacacttgctttctgactttaagaattcaatatccagactgaggtggttttgaaactggaaggagataaagctgaaaaccagagttgtgctgggaaacctggacgtagagcgctgagccccccagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaacc

SEQ ID NO: 166269 - DNA, 3875 bp, Homo sapiens
  Payload ID: 12735
  Gene Symbol: PIWIL1
  Gene Name: piwi-like RNA-mediated gene silencing 1
  Uniprot ID: Q96J94
  ENST ID: ENST00000613226
  CDS Start-End: 273-2858
gttactgggcgtatggcgtacagacacgaggccggcgcccgggaggcggtgttcatccgcccgggaaaagagcgcctgttgctcgctgcccgcgtgtccctggctctctcgggaacccagcgccgaaggcgaggtgggcgcgggccgaaggaggtcctgggaggtcggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatacgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttatttgaataactgtaattcttgttttactgaaagtatgtgcgtttccttttcatttaatttttaaaagtgcatacaattccattcataaaagctaaattagcctgaccaacatggtgaaaccccatctctactaaaaatacaaaattagccagatgtggtgccaggaggctgaggcaggagaatcacttgaacctgagaggcggaggttgcagtgagcagagatcacgccactgcactccagcctgggcaacagagtgagactccgtctcaaaaaaaaaaaaaaaaaa

SEQ ID NO: 166270 - DNA, 2579 bp, Homo sapiens
  Payload ID: 12735
  Gene Symbol: PIWIL1
  Gene Name: piwi-like RNA-mediated gene silencing 1
  Uniprot ID: Q96J94
  ENST ID: ENST00000632888
  CDS Start-End: 54-2543
aggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccagtaagtgcttctacttgttgatgtttagcaaataaaggacattcacttttcaaaatg

SEQ ID NO: 166271 - DNA, 571 bp, Homo sapiens; identical to SEQ ID NO: 166267
  Payload ID: 12735
  Gene Symbol: PIWIL1
  Gene Name: piwi-like RNA-mediated gene silencing 1
  ENST ID: ENST00000634077
  CDS Start-End: 77-571

SEQ ID NO: 166272 - DNA, 467 bp, Homo sapiens; identical to SEQ ID NO: 166266
  Payload ID: 12735
  Gene Symbol: PIWIL1
  Gene Name: piwi-like RNA-mediated gene silencing 1
  ENST ID: ENST00000633272
  CDS Start-End: 101-467

SEQ ID NO: 166273 - DNA, 879 bp, Homo sapiens; identical to SEQ ID NO: 166264
  Payload ID: 12735
  Gene Symbol: PIWIL1
  Gene Name: piwi-like RNA-mediated gene silencing 1
  ENST ID: ENST00000633042
  CDS Start-End: 362-879

SEQ ID NO: 166274 - DNA, 566 bp, Homo sapiens; identical to SEQ ID NO: 166268
  Payload ID: 12735
  Gene Symbol: PIWIL1
  Gene Name: piwi-like RNA-mediated gene silencing 1
  ENST ID: ENST00000634115
  CDS Start-End: 215-566

SEQ ID NO: 166275 - DNA, 545 bp, Homo sapiens; identical to SEQ ID NO: 166265
  Payload ID: 12735
  Gene Symbol: PIWIL1
  Gene Name: piwi-like RNA-mediated gene silencing 1
  ENST ID: ENST00000633252
  CDS Start-End: 95-545

SEQ ID NO: 166276 - DNA, 5128 bp, Homo sapiens
  Payload ID: 12736
  Gene Symbol: PIWIL2
  Gene Name: piwi-like RNA-mediated gene silencing 2
  Uniprot ID: Q8TC59
  ENST ID: ENST00000356766
  CDS Start-End: 149-3070
gaaattggccctggagcatgtgggccccggggcgtgggttgagctcggtcttcccctgaggccgcgcggagctgggcgactggggcgaggactcgcgcacaggtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggtgagaagaaaggcggcctcagaactcagctgtgactcttgcagaatcaacagagactgaagtgggcttttgtgttataattttccctttctccaaccctgtagaataagatttctttcttgtcttttaaacctaatatcaccaagaagcaagtttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctcaaaaaaaaaaaaaaaaagccaacatgagctgcagaaaccagcagaagcagccattatacttctaagctgtgccaactaagtggttcccatttctggagccagagatgataattaagtcattgcaagttgcctgaagagaattactcaggcaactgggaaaggcagtggaaggtctgtgaagcaaagttttcaagtagatattgctattactggcaggtgtgcaaggcgtgtagtaaaatcagtttgtggcataggtcggcccttgctgactaaatcctctctggggattgaattgatgacgactgtgacttgagttggattcgaaaatggcttcccttggcctcttgaaagagtgcagatgaagccttttccgtggatttcagtaactttccagcataccatgacgatttcttccccaaatatacacatgctcttttgctctttgtgcctgatcttcagtaatttttagttttttaacaggcagaaaaaatctagcagctaggaaagttcaagttggggtgggagtttttagtgaacttttctcccaggtgtgtggcctttatttctatttatatatgtttgtaaatggaattaccccctttctcttgcaaaataaccgcttcctggctgttggctcactttgctggaatttttctgaatccaggttaagatttccagaagtcagctttggaaaacgtgacactcctaccaaagtccagatggttagaaagttatcacataccatgggtttcagtgtttttggaaacccgtttttttctggttttttttcccccctctccattttagaatcttctcccagtcccttcgggcctagttctgtctcatcttgctttattgggttttaaaaaccggtcttatttaagcttttctaatttgtatttatgtacttatttattttttggtatgatggcagggaggggacaaagcagaaataccccttttatatgacaatgtgtgagaaaagaaactttagcttaaaactccgtaaaatgtgctcacttcagcagcacatatactaaaattaaaatgatatagagaagattagcatatagaaaaaaagaaaaaagatttccttaaaacaagaaaaccaagaatgtttttggtttgttgcggtgcccagccgaggttgaggagggatgggtattgttggtgcactgctggtttcatttggagtgtgggacattagggtgagacaaggacctggaatttaaaaaccacagaatcaaacactgtgaaccactggtctctggctaagcagatcagttttctgattttccttggaagcgttttgaatttttctgttgaagttggatttcctaatactttttttctcttagataatcagaacaaatggttgaatacattataatacaaaaatttcttcactttttattcttggttttcttgcctcgtttttcggttttaatgccaaatgattgggtcatggggtgggaaataaaaacaactttgt

SEQ ID NO: 166277 - DNA, 3442 bp, Homo sapiens
  Payload ID: 12736
  Gene Symbol: PIWIL2
  Gene Name: piwi-like RNA-mediated gene silencing 2
  Uniprot ID: Q8TC59
  ENST ID: ENST00000454009
  CDS Start-End: 510-3431
attcgaggcccggcgccgcggccccaagaaggtgtccaggttggggcggcaggggaggccctccggaggcccaagtggacgtcttatttggcctgagagaggagatagaacccctggcagggctgtggctttggggaaaggtgcttttctcggggtggaaaggggatgggactcgccttcgggggccttgcttctggttaggcccgagtcgcgaggcctcagcgcggagcacgcacccagggatgcgagggaggcaggcccagcccgtcctgggttcgctccccattgaacctttcggacagccaagtatctgctacctgatcccagggggaaacccacactgggagagggccctctgggggagctacctgaatctatagaagtggtgctggaggttgagggaagcgtggacaaagaggaagattccagatgtcccttaagggaggccgtccagcgcttctgagtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagctt

SEQ ID NO: 166278 - DNA, 3488 bp, Homo sapiens
  Payload ID: 12736
  Gene Symbol: PIWIL2
  Gene Name: piwi-like RNA-mediated gene silencing 2
  Uniprot ID: Q8TC59
  ENST ID: ENST00000521356
  CDS Start-End: 109-2922
gagctcggtcttcccctgaggccgcgcggagctgggcgactggggcgaggactcgcgcacaggtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggtgagaagaaaggcggcctcagaactcagctgtgactcttgcagaatcaacagagactgaagtgggcttttgtgttataattttccctttctccaaccctgtagaataagatttctttcttgtcttttaaacctaatatcaccaagaagcaagtttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctc

SEQ ID NO: 166279 - DNA, 2864 bp, Homo sapiens
  Payload ID: 12736
  Gene Symbol: PIWIL2
  Gene Name: piwi-like RNA-mediated gene silencing 2
  Uniprot ID: Q8TC59
  ENST ID: ENST00000611073
  CDS Start-End: 26-2839
gacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggt

SEQ ID NO: 166280 - DNA, 3504 bp, Homo sapiens
  Payload ID: 12737
  Gene Symbol: PIWIL3
  Gene Name: piwi-like RNA-mediated gene silencing 3
  Uniprot ID: Q7Z3Z3
  ENST ID: ENST00000332271
  CDS Start-End: 418-3066
tgctgcctcagcctcccgagtagctgggactacaggtgcccgccaccacgcccggctaattttttgtatttttagtagagatagggtttcactgtgttagccaggatggtctccatctcctgacctcatgatctacccgcctcagcctgccaaagtgctgggattacaggcgtgagccaccgcgcccggccaaagcggtttttaaagggaggatttggaaggcaaaagaggcagggggactgggaggtgtcaggtggtgtgaccccctccagtggcttgtcctgaattatttttccatctgtggaagtggccggcgtcatcatggctggaggaggtgcatggttcgtatcaggatctgactactgaagcttctaaggaaatatgtgaccagataaggtcatcaccttcaggaccacaatgcctggtagggcaaggactcgcgcccgaggcagagcccgccgcagggagagctaccaacaagaggcacctgggggacccagagcacctggatcagctacaacccaggagccccctcagttgcagtcgacaccccggccgctgcaggaggaagtcccagtggttagacctctgcagccaagagcagcaagaggaggagcaggaggaggagcacagtctcaaggggtgaaggaacctggacctgaggctgggttgcatacagcgcccttgcaggagagaaggattggtggagtttttcaagacctggtggtgaacaccaggcaagatatgaagcatgttaaagactcaaaaacaggttcagagggtacagtggtacagctactcgccaaccacttccgagtgatatctcgtcctcagtgggttgcatataaatacaacgttgactacaaaccagacatagaagatggaaatctccgtacaattttacttgatcaacatagaaggaaatttggagagcgccatatatttgatggaaactctttattattatctcggccactaaaagagcggagagtggaatggttgagcacaaccaaagacaaaaacatcgtgaagattacagttgagttttccaaagaactcacgcccacgtcgccagattgcctacgctattacaacattctctttagaagaactttcaagctgctggattttgaacaagttggtcgcaactattataccaaaaagaaggccattcagttataccgtcatggtaccagtttggaaatctggcttggttatgttacttctgttcttcaatacgaaaacagcattaccctctgtgccgatgtgagccacaaactgctccgaatagaaactgcttatgatttcataaagagaacatctgcccaggcccagacaggaaacatccgagaggaagtaactaataaattaattggatcaattgttctgacaaaatacaacaacaaaacctacagagtagatgatattgattggaagcagaatcctgaagacacatttaacaaatcagatggcagcaaaatcacctatatagactactacaggcagcaacataaagaaattgtcacagtgaagaaacagccacttttggtcagccagggcagatggaaaaagggcctaacgggtacacaacgtgaacctatcctgctgattcctcagctgtgccacatgacaggtctaacagatgaaatatgtaaagattatagcattgtgaaagaattggctaaacatacaagattgagtccaagaagaaggcatcatacattaaaagaattcatcaatactctacaagataataaaaaagtacgagagttacttcaactctgggatttgaaatttgataccaattttttgtccgtcccgggaagagttttgaaaaacgcaaacatcgtgcaaggcagaagaatggttaaagccaattcacaaggagactggtcaagagaaataagagaattacccttacttaatgcaatgccactacatagttggctcatactctatagcaggagcagtcacagagaagccatgtccttaaagggtcatctacagagtgtcacagcccccatgggcataactatgaaaccagcagaaatgattgaagtagatggtgatgctaactcctatatagacacattacggaaatatactagaccaacactgcagatgggaatgtcatgtttgctggttttcaaggtgatttgtatcctgcccaatgatgacaaacgtagatatgacagcataaaaagatacctatgtaccaaatgcccaattccaagccagtgtgtggtgaaaaagaccttagaaaaagtccaggcaaggaccatcgtcaccaagattgcccagcagatgaattgcaagatgggaggagccctctggaaggtggagacagacgtacaaagaacaatgttcgttggcattgattgtttccacgatatcgtaaatcgacagaaatcaatagcaggatttgttgcaagtaccaatgctgaattaacaaagtggtactctcaatgtgtcatccagaaaacaggagaagagcttgtgaaagagctggagatctgcttgaaagctgccctggatgtctggtgtaaaaacgaatcatcgatgccacattctgttattgtgtatcgggatggagtgggagatggtcagcttcaagcattgcttgaccatgaagcgaaaaagatgtcgacctacttaaaaaccatctctcctaacaatttcactctagctttcattgtggtgaagaaacgaataaacactagattttttcttaaacatggaagcaattttcaaaatccacctccaggaacagttattgatgtagagttgactaggaatgaatggtatgacttttttattgtgagtcagtctgtgcaagatgggactgttacccccactcattataacgtcatctatgacacgattggcttgagcccagatacagtacagcgtttaacatattgtctatgccacatgtattataatttgccaggcatcatccgagttccagcgccttgccactatgcccacaagctggcttacctcgtggggcagtccattcaccaggaaccgaatcgttccttgtcaactcgtctcttttacctttgacctgcagaagaagacctgatgtgctaatgaaaccacaacgtgtaagcctgtcttccttttgaagcaggatgtctgaaatattttcctaggtccatagcattaaattctcatcgtttttgattggacacaggagagattcagagtgatatgttctactctcaatactaccacagactgatttttccagagaggagaactgacagggtttggcttgcagtttccctttcaaatatgtgacagagatctcacagctgaacgtgactgaacattttccaccccaagcagggccactctaagaattgaaaagatggggcattcgtcacagagagagtacatctgtgaacaagtaaactctacttggaaaactacgtttactttatttttgaaacttttttttgttaaaggacaggaaaggaagacataaaagtaacaacactg

SEQ ID NO: 166281 - DNA, 3232 bp, Homo sapiens
  Payload ID: 12737
  Gene Symbol: PIWIL3
  Gene Name: piwi-like RNA-mediated gene silencing 3
  ENST ID: ENST00000533313
  CDS Start-End: 716-3010
ctgggaggtgtcaggtggtgtgaccccctccagtggcttgtcctgaattatttttccatctgtggaagtggccggcgtcatcatggctggaggaggtgcatggttcgtatcaggatctgactactgaagcttctaaggaaatatgtgaccagataaagttttgccgttgttgcccaggccagagtgcggtggcacaatctcgactcactgcaacctctctctccaggattcaagcgattcttctgcctcagcctcccaagtagctgggattacagggtcatcaccttcaggaccacaatgcctggtagggcaaggactcgcgcccgaggcagagcccgccgcagggagagctaccaacaagaggcacctgggggacccagagcacctggatcagctacagtgagccctgtaacgttgtttcctttctgcaagagatatgtgcctgtactgaaaagaacatagagttggttgttgagcgaagctagttcagacccaggagccccctcagttgcagtcgacaccccggccgctgcaggaggaagtcccagtggttagacctctgcagccaagagcagcaagaggaggagcaggaggaggagcacagtctcaaggggtgaaggaacctggacctgaggctgggttgcatacagcgcccttgcaggagagaaggattggtggagtttttcaagacctggtggtgaacaccaggcaagatatgaagcatgttaaagactcaaaaacaggttcagagggtacagtggtacagctactcgccaaccacttccgagtgatatctcgtcctcagtgggttgcatataaatacaacgttgactacaaaccagacatagaagatggaaatctccgtacaattttacttgatcaacatagaaggaaatttggagagcgccatatatttgatggaaactctttattattatctcggccactaaaagagcggagagtggaatggttgagcacaaccaaagacaaaaacatcgtgaagattacagttgagttttccaaagaactcacgcccacgtcgccagattgcctacgctattacaacattctctttagaagaactttcaagctgctggattttgaacaagttggtcgcaactattataccaaaaagaaggccattcagttataccgtcatggtaccagtttggaaatctggcttggttatgttacttctgttcttcaatacgaaaacagcattaccctctgtgccgatgtgagccacaaactgctccgaatagaaactgcttatgatttcataaagagaacatctgcccaggcccagacaggaaacatccgagaggaagtaactaataaattaattggatcaattgttctgacaaaatacaacaacaaaacctacagagtagatgatattgattggaagcagaatcctgaagacacatttaacaaatcagatggcagcaaaatcacctatatagactactacaggcagcaacataaagaaattgtcacagtgaagaaacagccacttttggtcagccagggcagatggaaaaagggcctaacgggtacacaacgtgaacctatcctgctgattcctcagctgtgccacatgacaggtctaacagatgaaatatgtaaagattatagcattgtgaaagaattggctaaacatacaagattgagtccaagaagaaggcatcatacattaaaagaattcatcaatactctacaagataataaaaaagtacgagagttacttcaactctgggatttgaaatttgataccaattttttgtccgtcccgggaagagttttgaaaaacgcaaacatcgtgcaaggcagaagaatggttaaagccaattcacaaggagactggtcaagagaaataagagaattacccttacttaatgcaatgccactacatagttggctcatactctatagcaggagcagtcacagagaagccatgtccttaaagggtcatctacagagtgtcacagcccccatgggcataactatgaaaccagcagaaatgattgaagtagatggtgatgctaactcctatatagacacattacggaaatatactagaccaacactgcagatggtgatttgtatcctgcccaatgatgacaaacgtagatatgacagcataaaaagatacctatgtaccaaatgcccaattccaagccagtgtgtggtgaaaaagaccttagaaaaagtccaggcaaggaccatcgtcaccaagattgcccagcagatgaattgcaagatgggaggagccctctggaaggtggagacagacgtacaaagaacaatgttcgttggcattgattgtttccacgatatcgtaaatcgacagaaatcaatagcaggatttgttgcaagtaccaatgctgaattaacaaagtggtactctcaatgtgtcatccagaaaacaggagaagagcttgtgaaagagctggagatctgcttgaaagctgccctggatgtctggtgtaaaaacgaatcatcgatgccacattctgttattgtgtatcgggatggagtgggagatggtcagcttcaagcattgcttgaccatgaagcgaaaaagatgtcgacctacttaaaaaccatctctcctaacaatttcactctagctttcattgtggtgaagaaacgaataaacactagattttttcttaaacatggaagcaattttcaaaatccacctccaggaacagttattgatgtagagttgactaggaatgaatggtatgacttttttattgtgagtcagtctgtgcaagatgggactgttacccccactcattataacgtcatctatgacacgattggcttgagcccagatacagtacagcgtttaacatattgtctatgccacatgtattataatttgccaggcatcatccgagttccagcgccttgccactatgcccacaagctggcttacctcgtggggcagtccattcaccaggaaccgaatcgttccttgtcaactcgtctcttttacctttgacctgcagaagaagacctgatgtgctaatgaaaccacaacgtgtaagcctgtcttccttttgaagcaggatgtctgaaatattttcctaggtccatagcattaaattctcatcgtttttgattggacacaggagagattcagagtgatatgttctactctcaatactaccacagactgatttttccagagaggagaactgacagggtttggcttgcagtttcc

SEQ ID NO: 166282 - DNA, 3105 bp, Homo sapiens
  Payload ID: 12737
  Gene Symbol: PIWIL3
  Gene Name: piwi-like RNA-mediated gene silencing 3
  ENST ID: ENST00000527701
  CDS Start-End: 589-2883
ctgggaggtgtcaggtggtgtgaccccctccagtggcttgtcctgaattatttttccatctgtggaagtggccggcgtcatcatggctggaggaggtgcatggttcgtatcaggatctgactactgaagcttctaaggaaatatgtgaccagataaggtcatcaccttcaggaccacaatgcctggtagggcaaggactcgcgcccgaggcagagcccgccgcagggagagctaccaacaagaggcacctgggggacccagagcacctggatcagctacagatccatagtggcgctgcggggccccatctgacaacctccagggggaccatatactgcatggaagtagcacgatgccttccagacccaggagccccctcagttgcagtcgacaccccggccgctgcaggaggaagtcccagtggttagacctctgcagccaagagcagcaagaggaggagcaggaggaggagcacagtctcaaggggtgaaggaacctggacctgaggctgggttgcatacagcgcccttgcaggagagaaggattggtggagtttttcaagacctggtggtgaacaccaggcaagatatgaagcatgttaaagactcaaaaacaggttcagagggtacagtggtacagctactcgccaaccacttccgagtgatatctcgtcctcagtgggttgcatataaatacaacgttgactacaaaccagacatagaagatggaaatctccgtacaattttacttgatcaacatagaaggaaatttggagagcgccatatatttgatggaaactctttattattatctcggccactaaaagagcggagagtggaatggttgagcacaaccaaagacaaaaacatcgtgaagattacagttgagttttccaaagaactcacgcccacgtcgccagattgcctacgctattacaacattctctttagaagaactttcaagctgctggattttgaacaagttggtcgcaactattataccaaaaagaaggccattcagttataccgtcatggtaccagtttggaaatctggcttggttatgttacttctgttcttcaatacgaaaacagcattaccctctgtgccgatgtgagccacaaactgctccgaatagaaactgcttatgatttcataaagagaacatctgcccaggcccagacaggaaacatccgagaggaagtaactaataaattaattggatcaattgttctgacaaaatacaacaacaaaacctacagagtagatgatattgattggaagcagaatcctgaagacacatttaacaaatcagatggcagcaaaatcacctatatagactactacaggcagcaacataaagaaattgtcacagtgaagaaacagccacttttggtcagccagggcagatggaaaaagggcctaacgggtacacaacgtgaacctatcctgctgattcctcagctgtgccacatgacaggtctaacagatgaaatatgtaaagattatagcattgtgaaagaattggctaaacatacaagattgagtccaagaagaaggcatcatacattaaaagaattcatcaatactctacaagataataaaaaagtacgagagttacttcaactctgggatttgaaatttgataccaattttttgtccgtcccgggaagagttttgaaaaacgcaaacatcgtgcaaggcagaagaatggttaaagccaattcacaaggagactggtcaagagaaataagagaattacccttacttaatgcaatgccactacatagttggctcatactctatagcaggagcagtcacagagaagccatgtccttaaagggtcatctacagagtgtcacagcccccatgggcataactatgaaaccagcagaaatgattgaagtagatggtgatgctaactcctatatagacacattacggaaatatactagaccaacactgcagatggtgatttgtatcctgcccaatgatgacaaacgtagatatgacagcataaaaagatacctatgtaccaaatgcccaattccaagccagtgtgtggtgaaaaagaccttagaaaaagtccaggcaaggaccatcgtcaccaagattgcccagcagatgaattgcaagatgggaggagccctctggaaggtggagacagacgtacaaagaacaatgttcgttggcattgattgtttccacgatatcgtaaatcgacagaaatcaatagcaggatttgttgcaagtaccaatgctgaattaacaaagtggtactctcaatgtgtcatccagaaaacaggagaagagcttgtgaaagagctggagatctgcttgaaagctgccctggatgtctggtgtaaaaacgaatcatcgatgccacattctgttattgtgtatcgggatggagtgggagatggtcagcttcaagcattgcttgaccatgaagcgaaaaagatgtcgacctacttaaaaaccatctctcctaacaatttcactctagctttcattgtggtgaagaaacgaataaacactagattttttcttaaacatggaagcaattttcaaaatccacctccaggaacagttattgatgtagagttgactaggaatgaatggtatgacttttttattgtgagtcagtctgtgcaagatgggactgttacccccactcattataacgtcatctatgacacgattggcttgagcccagatacagtacagcgtttaacatattgtctatgccacatgtattataatttgccaggcatcatccgagttccagcgccttgccactatgcccacaagctggcttacctcgtggggcagtccattcaccaggaaccgaatcgttccttgtcaactcgtctcttttacctttgacctgcagaagaagacctgatgtgctaatgaaaccacaacgtgtaagcctgtcttccttttgaagcaggatgtctgaaatattttcctaggtccatagcattaaattctcatcgtttttgattggacacaggagagattcagagtgatatgttctactctcaatactaccacagactgatttttccagagaggagaactgacagggtttggcttgcagtttcc

SEQ ID NO: 166283 - DNA, 3111 bp, Homo sapiens
  Payload ID: 12737
  Gene Symbol: PIWIL3
  Gene Name: piwi-like RNA-mediated gene silencing 3
  Uniprot ID: Q7Z3Z3
  ENST ID: ENST00000616349
  CDS Start-End: 25-2673
agggtcatcaccttcaggaccacaatgcctggtagggcaaggactcgcgcccgaggcagagcccgccgcagggagagctaccaacaagaggcacctgggggacccagagcacctggatcagctacaacccaggagccccctcagttgcagtcgacaccccggccgctgcaggaggaagtcccagtggttagacctctgcagccaagagcagcaagaggaggagcaggaggaggagcacagtctcaaggggtgaaggaacctggacctgaggctgggttgcatacagcgcccttgcaggagagaaggattggtggagtttttcaagacctggtggtgaacaccaggcaagatatgaagcatgttaaagactcaaaaacaggttcagagggtacagtggtacagctactcgccaaccacttccgagtgatatctcgtcctcagtgggttgcatataaatacaacgttgactacaaaccagacatagaagatggaaatctccgtacaattttacttgatcaacatagaaggaaatttggagagcgccatatatttgatggaaactctttattattatctcggccactaaaagagcggagagtggaatggttgagcacaaccaaagacaaaaacatcgtgaagattacagttgagttttccaaagaactcacgcccacgtcgccagattgcctacgctattacaacattctctttagaagaactttcaagctgctggattttgaacaagttggtcgcaactattataccaaaaagaaggccattcagttataccgtcatggtaccagtttggaaatctggcttggttatgttacttctgttcttcaatacgaaaacagcattaccctctgtgccgatgtgagccacaaactgctccgaatagaaactgcttatgatttcataaagagaacatctgcccaggcccagacaggaaacatccgagaggaagtaactaataaattaattggatcaattgttctgacaaaatacaacaacaaaacctacagagtagatgatattgattggaagcagaatcctgaagacacatttaacaaatcagatggcagcaaaatcacctatatagactactacaggcagcaacataaagaaattgtcacagtgaagaaacagccacttttggtcagccagggcagatggaaaaagggcctaacgggtacacaacgtgaacctatcctgctgattcctcagctgtgccacatgacaggtctaacagatgaaatatgtaaagattatagcattgtgaaagaattggctaaacatacaagattgagtccaagaagaaggcatcatacattaaaagaattcatcaatactctacaagataataaaaaagtacgagagttacttcaactctgggatttgaaatttgataccaattttttgtccgtcccgggaagagttttgaaaaacgcaaacatcgtgcaaggcagaagaatggttaaagccaattcacaaggagactggtcaagagaaataagagaattacccttacttaatgcaatgccactacatagttggctcatactctatagcaggagcagtcacagagaagccatgtccttaaagggtcatctacagagtgtcacagcccccatgggcataactatgaaaccagcagaaatgattgaagtagatggtgatgctaactcctatatagacacattacggaaatatactagaccaacactgcagatgggaatgtcatgtttgctggttttcaaggtgatttgtatcctgcccaatgatgacaaacgtagatatgacagcataaaaagatacctatgtaccaaatgcccaattccaagccagtgtgtggtgaaaaagaccttagaaaaagtccaggcaaggaccatcgtcaccaagattgcccagcagatgaattgcaagatgggaggagccctctggaaggtggagacagacgtacaaagaacaatgttcgttggcattgattgtttccacgatatcgtaaatcgacagaaatcaatagcaggatttgttgcaagtaccaatgctgaattaacaaagtggtactctcaatgtgtcatccagaaaacaggagaagagcttgtgaaagagctggagatctgcttgaaagctgccctggatgtctggtgtaaaaacgaatcatcgatgccacattctgttattgtgtatcgggatggagtgggagatggtcagcttcaagcattgcttgaccatgaagcgaaaaagatgtcgacctacttaaaaaccatctctcctaacaatttcactctagctttcattgtggtgaagaaacgaataaacactagattttttcttaaacatggaagcaattttcaaaatccacctccaggaacagttattgatgtagagttgactaggaatgaatggtatgacttttttattgtgagtcagtctgtgcaagatgggactgttacccccactcattataacgtcatctatgacacgattggcttgagcccagatacagtacagcgtttaacatattgtctatgccacatgtattataatttgccaggcatcatccgagttccagcgccttgccactatgcccacaagctggcttacctcgtggggcagtccattcaccaggaaccgaatcgttccttgtcaactcgtctcttttacctttgacctgcagaagaagacctgatgtgctaatgaaaccacaacgtgtaagcctgtcttccttttgaagcaggatgtctgaaatattttcctaggtccatagcattaaattctcatcgtttttgattggacacaggagagattcagagtgatatgttctactctcaatactaccacagactgatttttccagagaggagaactgacagggtttggcttgcagtttccctttcaaatatgtgacagagatctcacagctgaacgtgactgaacattttccaccccaagcagggccactctaagaattgaaaagatggggcattcgtcacagagagagtacatctgtgaacaagtaaactctacttggaaaactacgtttactttatttttgaaacttttttttgttaaaggacaggaaaggaagacataaaagtaacaacactg

SEQ ID NO: 166284 - DNA, 3199 bp, Homo sapiens
  Payload ID: 12738
  Gene Symbol: PIWIL4
  Gene Name: piwi-like RNA-mediated gene silencing 4
  Uniprot ID: Q7Z3Z4
  ENST ID: ENST00000299001
  CDS Start-End: 212-2770
gtgctcgcgccaacccctacgccccagcgcgccttctccacccacgcacgggcctcggacgcatttccagccccggcgttggttgtggatgctggacatccaccgcctccaggcagtttcgccgtcacaccgtcgccatctgtagccaaagcaaaacatatcctaactgagactttgcagctcttgtggccactctgggctcaccgggaacatgagtggaagagcccgagtgaaggccagaggcatcgcccgcagccccagtgccacagaagtggggcgcatccaagcctcgccattgcctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaaattatccctttggcctgggtttgccatttctgtgtcatattttgaaaggaagctcctgtttagtgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatcataaaagtacaagaaaatccagctgcatttgttagagctatacagcaatatgttgatcctgatgttcagctggtaatgtgcattctgccttctaatcagaagacctattatgattccattaaaaaatatttgagctcagactgcccagtcccaagccaatgtgtgcttgctcggaccttgaataaacagggcatgatgatgagtatcgccaccaagatcgctatgcagatgacttgcaagctcggaggcgagctgtgggctgtggaaatacctttaaagtccctgatggtggtcggtattgatgtctgtaaagatgcactcagcaaggacgtgatggttgttggatgcgtggccagtgttaaccccagaatcaccaggtggttttcccgctgtatccttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgacagataaacagagtctaattcccaccccaaattttgctgaggttttcttaatgttgtagagcattttgtagagtggtttaaatagttgaaaataaagttcagaacatca

SEQ ID NO: 166285 - DNA, 3759 bp, Homo sapiens
  Payload ID: 12738
  Gene Symbol: PIWIL4
  Gene Name: piwi-like RNA-mediated gene silencing 4
  Uniprot ID: Q7Z3Z4
  ENST ID: ENST00000446230
  CDS Start-End: 528-2015
gtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggacctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaaattatccctttggcctgggtttgccatttctgtgtcatattttgaaaggaagctcctgtttagtgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatgtaatgtgcattctgccttctaatcagaagacctattatgattccattaaaaaatatttgagctcagactgcccagtcccaagccaatgtgtgcttgctcggaccttgaataaacagggcatgatgatgagtatcgccaccaagatcgctatgcagatgacttgcaagctcggaggcgagctgtgggctgtggaaatacctgtgcatagccaagtgaggattccttagagatctgaagaatgaagaatggaattcctcttcagattgctccagaccagaggcaagcgatagatacactgaccacactcccagaatctctttagccactggtgccccttccccaccccacaaaggatgatggttatcttggacggtagtgtttctcttaagataagtgtgtaccatattcttcctgccttctttaagtctctctcatttctggtttaataatctggctcacggatctcaatctcccttacacatagcttaactttaagaattcagtaactggagtctgtttttaaaaactttcctattaaaccattggtaggggaaatgatacctcatcccattaaatcatgacaaatttaattttatagttaaagtccctgatggtggtcggtattgatgtctgtaaagatgcactcagcaaggacgtgatggttgttggatgcgtggccagtgttaaccccagaatcaccaggtggttttcccgctgtatccttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgacagataaacagagtctaattcccaccccaaattttgctgaggttttcttaatgttgtagagcattttgtagagtggtttaaatagttgaaaataaagttcagaacatca

SEQ ID NO: 166286 - DNA, 831 bp, Homo sapiens
  Payload ID: 12738
  Gene Symbol: PIWIL4
  Gene Name: piwi-like RNA-mediated gene silencing 4
  ENST ID: ENST00000537419
  CDS Start-End: 99-710
gttatccattgttatattcttgcaaatataacccaaattatgtattgccctattttacagtggtctgaaatagcaaacccatttaaacactgcaatatatgggaatgttattttttgttggcattagaaaagtaattcttttcttactgacaccaaattctgcaggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtc

SEQ ID NO: 166287 - DNA, 587 bp, Homo sapiens
  Payload ID: 12738
  Gene Symbol: PIWIL4
  Gene Name: piwi-like RNA-mediated gene silencing 4
  ENST ID: ENST00000545603
  CDS Start-End: 233-587
ctcctctctgttacgaagtagtgcgttatcttttctctcaagtttgagtctttccaaggtttcttctaacagttttctccttctagggatcttgtctgagtaagatattaaccctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatga

SEQ ID NO: 166288 - DNA, 1901 bp, Homo sapiens
  Payload ID: 12738
  Gene Symbol: PIWIL4
  Gene Name: piwi-like RNA-mediated gene silencing 4
  Uniprot ID: Q7Z3Z4
  ENST ID: ENST00000543336
  CDS Start-End: 271-1632
ctccctccctcaatccctccctccggcgggcgtcgctggcgggtggctaggcccaacggcaggaagccgacgctatcctccgttccgcggcgccgggtccgccttccgtctgttctagggcctgctcctgcgcggcagctgctttagaagcctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaaattatccctttggcctgggtttgccatttctgtgtcatattttgaaaggaagctcctgtttagtgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatgtaatgtgcattctgccttctaatcagaagacctattatgattccattaaaaaatatttgagctcagactgcccagtcccaagccaatgtgtgcttgctcggaccttgaataaacagggcatgatgatgagtatcgccaccaagatcgctatgcagatgacttgcaagctcggaggcgagctgtgggctgtggaaatacctgtggttttcccgctgtatccttcagagaacaatgactgatgttgcagattgcttgaaagttttcatgactgg

SEQ ID NO: 166289 - DNA, 638 bp, Homo sapiens
  Payload ID: 12739
  Gene Symbol: PLAC8L1
  Gene Name: PLAC8-like 1
  Uniprot ID: A1L4L8
  ENST ID: ENST00000311450
  CDS Start-End: 59-592
ccagcttattgccaaagggaaaaaggatagcccaaaggacaagaaaacacttctcactatgaattggtttggaagtaacttcttcaggtgtcctgaggatctttccttactcaacatatactcacctctgttgtcacacatgtcatctgaagatgaacattttatttccaacttgagaggccatgtaccagccagcgctgtggtgaagcagcctgttcggggagccagtggcaggacgacaatcacagcaattgtccagactggcgggggctggagcaccggtctcttcagtgtctgcagagataggagaatttgtttctgtggtctattctgtcctatgtgtcttgagtgtgacatcgccaggcattatggagagtgtctttgttggccgttgttacctgggtccacctttgcactgagaattggcaccagggagagacataaaatacagggcacactgtgtgaagactggctggcggtgcactgctgttgggctttttccatctgccaggtggcccgggaactcaagatgaggacctcccaagtctatgaaatctgtgcagtcccaatgactaaggacaccctggtttgacagcaagataactcctcctccttactccccaacaccctcctctcaa

SEQ ID NO: 166290 - DNA, 621 bp, Homo sapiens
  Payload ID: 12739
  Gene Symbol: PLAC8L1
  Gene Name: PLAC8-like 1
  ENST ID: ENST00000512998
  CDS Start-End: 59-319
ccagcttattgccaaagggaaaaaggatagcccaaaggacaagaaaacacttctcactatgaattggtttggaagtaacttcttcaggtgtcctgaggatctttccttactcaacatatactcacctctgttgtcacacatgtcatctgaagatgaacattttatttccaacttgagaggccatgtaccagccagcgctgtggtgaagcagcctgttcggggagccagtggcaggacgacaatcacagcaattgtccagactggcgggggctggagcaccggtctcttcagtgtctgcagagataggagaattttgtgacatcgccaggcattatggagagtgtctttgttggccgttgttacctgggtccacctttgcactgagaattggcaccagggagagacataaaatacagattctggtcttgccctagggcacactgtgtgaagactggctggcggtgcactgctgttgggctttttccatctgccaggtggcccgggaactcaagatgaggacctcccaagtctatgaaatctgtgcagtcccaatgactaaggacaccctggtttgacagcaagataactcctcctccttactccccaacaccctcctctcaa

SEQ ID NO: 166291 - DNA, 1215 bp, Homo sapiens
  Payload ID: 12740
  Gene Symbol: PLET1
  Gene Name: placenta expressed transcript 1
  Uniprot ID: Q6UQ28
  ENST ID: ENST00000338832
  CDS Start-End: 272-895
aatgacaggcgtaaaagaaaaccatattcaggacattccctttcttgagcaaaactgcaatttgcaaaatcatcggtgacaggtaatggtgactggtgattcattcctggtgatgtcttgggccaaattccagaatccaatgtatattcagaaggggcagggagaagatctgcatgtatgacttcacccagaagccctggcatataaacaagaggtgagttgtcagtttcacccaattccaggcctagcactttccaaacagactgagaccatggcagtcttccatgacatgctgctgcagccactggggatgtttctgtgcctcagtctgcagctttcttctgccacctttataaggtacagtagcacctgcttcacctttgatgaatactacaccataaccctagacatcaaggccagttcacatatctacgaaagcaatgcagtctattctgtatttgttcccgtgaatgacagcgtctatgctgtggtcatgaaaaccttggacgagaacagtgactcagcgggcctctggcaaagagcggataaaaattgctacagcaactccacgtattacgtgaaagatcaatacatgacggtcttagaggcacagtggcaagctcctgaacctgagaacataactgaagtggagatacaagctttcactgtccagatcagagcgctgcctatactttctactctgaagctaagagaaaaactgtcaaccttagccttagctgccaagattccccagagctcagccttcaagcctttcttcatgattacacccaagagtatcagactcgaaggcttggccaaccaagtcttcagcagccccatcacagaggccatttatatcctgcttgcttttctcaccagcacacttctcttctaaagggaagccagggaaacaattgtttctgcctccactgcatcctcctacattcagttccaagctagtgctgggaaccgaatgtgtgtaaatgaaggctttacattctcaaatgtgcaactttgctgccacggcttcagaccaaaacaaagatctggaggcactcattggcaggcttgggtcacatagatgttcatctggatctttcaggacacatattacactttttgaaaatatttagaactggccggaacttagtcacctaggttctccctattggttgaacaggttggcagccaattccacagccaatctcaactttt

SEQ ID NO: 166292 - DNA, 1693 bp, Homo sapiens
  Payload ID: 12741
  Gene Symbol: PGF
  Gene Name: placental growth factor
  ENST ID: ENST00000238607
  CDS Start-End: 336-845
ggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctctt

SEQ ID NO: 166293 - DNA, 666 bp, Homo sapiens
  Payload ID: 12741
  Gene Symbol: PGF
  Gene Name: placental growth factor
  Uniprot ID: P49763
  ENST ID: ENST00000405431
  CDS Start-End: 1-666
atgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccgccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtccctgaggaaattcccagaatgcaccctggaaggaacggaaaaaagcagcaaagaaagcctctgcgggagaagatgaagccggaaaggtgcggcgatgctgttccccggaggtaa

SEQ ID NO: 166294 - DNA, 1927 bp, Homo sapiens
  Payload ID: 12741
  Gene Symbol: PGF
  Gene Name: placental growth factor
  Uniprot ID: P49763
  ENST ID: ENST00000555567
  CDS Start-End: 543-1055
gtctggacctgccgagagcccctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaa

SEQ ID NO: 166295 - DNA, 1699 bp, Homo sapiens
  Payload ID: 12741
  Gene Symbol: PGF
  Gene Name: placental growth factor
  Uniprot ID: P49763
  ENST ID: ENST00000553716
  CDS Start-End: 385-834
aaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagt

SEQ ID NO: 166296 - DNA, 1131 bp, Homo sapiens
  Payload ID: 12742
  Gene Symbol: PLAC1
  Gene Name: placenta-specific 1
  Uniprot ID: Q9HBJ0
  ENST ID: ENST00000359237
  CDS Start-End: 287-925
atatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 166297 - DNA, 1447 bp, Homo sapiens
  Payload ID: 12743
  Gene Symbol: PLAC8
  Gene Name: placenta-specific 8
  Uniprot ID: Q9NZF1
  ENST ID: ENST00000311507
  CDS Start-End: 167-514
gcgtctgaaactgttctatgtactatgccctgcgatagaaacacagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaattcgaatttcctggcttataaactttttaaattacatttgaaatataaaccaaatgaaatattttactgataagattcttcatgcttctttgctctccttaaaatgtctttttcactagttagttccaagggtcagtctcataattttgttcttatactttgatttcctttttctttttttttttttttaatagagttgggggatctttctttctttttttttttttttttttgagatagagtctcgctctgttgcccaggctggagtgcagtggcgtgatctcagctcactgcaacctccacctcctggatacaagcgattctgctgcctcagtctcccgagtagctgggattacaggttcccgccaccatgcccagctaatttttgtatttttagtagagacggggtttcaccatcttggtcaggctggtctcgaactcctgacctcgtgatccacctgcctcggcatcacaaaatgctgggattacaggcatgagccaccgcgtccagcctagagttgggggtctttctatgttgcccaggctggtcttgaactccgggcctctagcaagcctctcatctcagcctcccaaggtgctggaattacaggtgtgagccactgcaccatactttggtttcttagcaggagattttggttcacagtaacccagctctctttcatctaagaactttagatgagaaaaaaaaaaaa

SEQ ID NO: 166298 - DNA, 2253 bp, Homo sapiens
  Payload ID: 12743
  Gene Symbol: PLAC8
  Gene Name: placenta-specific 8
  Uniprot ID: Q9NZF1
  ENST ID: ENST00000426923
  CDS Start-End: 80-427
tctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgagtcaatgcaaacatgcctctcagaacatgtgggtttttagaaatatcactaaagactttgtcaattatttgttgttttgaataattcagcaataactatttcttaagtctcctgaagtgctatcataatatcaagattggctttaattttcttcttatgaagaagatagctctatactttgaaaccatattttagtaaataaaggaatggtgaattttctaaacttctcagaattctggtgatctattaaggaagcacttaccacttgtaaaataccagagtatggtgagatacaaaagaattagaaaacatgttccctgctaagacaaacaagttgacaaaaggaattcgtaaataattataaaatagaagagtaaagaaaataacattctgtatgatatttggattgattgtggcataaagcatctatcatagcaaggtgaggttaaatagaaaactcctgttggagaagctgaactttgaaagaggtgaacatagaatttagaatgtttggaaatgttatatagaattaaccatctgaaattcaatcaagtcattttcaactaatttttctcaggactatctattgaggatgtagttaagtagaaatcaacatgacttactccatcccctgtagaatatatattaagtatgggaagaacacaatttttctactctttgtaatatccagtttccttcctgaagtgataaggactctgtatgggttaataaaaataactcttgggagatacgtaaaaaaatgttcatttacttagcaagtaatgtattaaggatctaggatcaagtatatattatcttagcaactaatgtatcaatgtatcaatatctaagactaggtaagatactgttaggtattgtagtagggttggggagcaagataaataagctagtccctctgtcattatagaatttatacgaaaaagggggattagacaaacccctaactaaaatgcagaattcaattaatgcctatagacaaagcggtattttatgttcagaggaggaaaagatcacatcttgtaagatgtataggtgaaagtttcttgaaagcagtgatttttaattctaaaggggaagtgcgtattagttctcaacaagaaacagatggcactcaaactgtgatagttcaaagatttaatgaagactaattataaaggtgtgggtggggcattgtagggagatgacaagggatggcataataacctgcctggcaacagccccagggaggagaagagggagcagtgacctgaatccttaaggagagagctgtgtgaagaggcctgccctgaaagaaacagtatcctctcaagagagggttgtgagcagcccgaggcaacccatagaactgaaaaagtaccctgacctcactttcggatgtccttctggttttcccattggctgaacccaccagaaaggcagagggcagcaaagtgtcacggtagtccgcaggtcgcttcccagggcacacagcaggatggtcaagggagtaagtaaatcagataggggcaaacagaggatcactgactcaagatgtggttttaattaatagaaatggaggctgagtgcagtggctcacacctgtgatcccagcactttgggaggccaaggcaagaggactgcttgaacccaggagttcaagaccagcctggggaacatgttgaaaccctgtctcttgaaaaaatacaaaaattagctaggtgtggtggtgcacgcctgtagtcccagatacttgggaggctgaggtgggaggatcacttgagcctgggaggtagaagctgcagtgagctatgat

SEQ ID NO: 166299 - DNA, 786 bp, Homo sapiens
  Payload ID: 12743
  Gene Symbol: PLAC8
  Gene Name: placenta-specific 8
  Uniprot ID: Q9NZF1
  ENST ID: ENST00000411416
  CDS Start-End: 146-493
gggtcccagagctgggctggcgggaggcgtaatccggcggggtgagggttgatcgaagagccccgcgcgcagctgccgctcacagccccttcccgagtgcagagcgggcagagaagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaattcgaatttcctggcttataaactttttaaattacatttgaaatataaaccaaatgaaatattttactgataa

SEQ ID NO: 166300 - DNA, 1025 bp, Homo sapiens
  Payload ID: 12743
  Gene Symbol: PLAC8
  Gene Name: placenta-specific 8
  Uniprot ID: Q9NZF1
  ENST ID: ENST00000505406
  CDS Start-End: 503-850
atttacttctgtctgtatcaggaaacagaggcctgggtctagagacagggtcttggtgagggaaggactcaaaaccatgggatacagcatgaccgggcagcaccacagctgtggaaggagtttccctgcacaagttctcttctgttgtctgcctccatgtgagacatgcctttcaccttctgccatgattgtgaggcttccccagccacatggaactgaccaggaccagggtgaggcaaacaaggtccctacgggcacagaatttaagaaggcactcactcttgatgaaactggaggaccaaaattttaaactatgggatcagaaattcaaagactatgaataaaaatttcaaaagaaagaaatagtaataccaccaataagaagaataattaaaaaggtacaaagaaattggatgcaacattgtaaaaagagccatagtttggagctgagctgacatgagctaaaatcctagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaactta

SEQ ID NO: 166301 - DNA, 489 bp, Homo sapiens
  Payload ID: 12743
  Gene Symbol: PLAC8
  Gene Name: placenta-specific 8
  ENST ID: ENST00000509973
  CDS Start-End: 125-301
agttttcatttgtggtgagattctctcccaggccacaagacatttcctgctcggaaccttgtttactaattgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgca

SEQ ID NO: 166302 - DNA, 785 bp, Homo sapiens
  Payload ID: 12744
  Gene Symbol: PLAC9
  Gene Name: placenta-specific 9
  Uniprot ID: Q5JTB6
  ENST ID: ENST00000372263
  CDS Start-End: 43-336
gctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtctcctctgtgtctgctgacagagtaacccgtttaactacagcctcctctcactccacttccatgcctggaggaagcctgcaaccccctccaggctcagacctggggacacccccactcctgtcatttataggggcagatggagcaggggttgattcacacagatgggggccctttgagtggccttgcttctcaaaatgtggccataggtgaaaagcaaggggatcagggtctcaggacccacccagactgtttaatccaaatctgcattgcaatgagacccccagggattttatgtgtccattaaagtggtttgttgttgtttttaaaaa

SEQ ID NO: 166303 - DNA, 472 bp, Homo sapiens
  Payload ID: 12744
  Gene Symbol: PLAC9
  Gene Name: placenta-specific 9
  ENST ID: ENST00000372267
  CDS Start-End: 173-436
cacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggcttctgagccctggagctggagcccagcagttggaggtggtgcacctgccaggcagcgcccacagaaccagccctgtcctctcgacttccttccttagcttcatgtgaaataaaagctattctggtctcctctg

SEQ ID NO: 166304 - DNA, 534 bp, Homo sapiens
  Payload ID: 12744
  Gene Symbol: PLAC9
  Gene Name: placenta-specific 9
  ENST ID: ENST00000372270
  CDS Start-End: 213-380
gaatttctccgtctgaggctactatcttgctctggaggagggagtgagaactggatcactggttagcgtggtaactgttttggacaattgcatagccacagccaggaacacagaaggcagagaggcagccttgatctgcaagagctccagctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtctcctctgtgtctgctgacagagtaacccgtttaa

SEQ ID NO: 166305 - DNA, 5447 bp, Homo sapiens
  Payload ID: 12745
  Gene Symbol: PKP1
  Gene Name: plakophilin 1
  Uniprot ID: Q13835
  ENST ID: ENST00000263946
  CDS Start-End: 252-2495
gggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaacttt

SEQ ID NO: 166306 - DNA, 2244 bp, Homo sapiens
  Payload ID: 12745
  Gene Symbol: PKP1
  Gene Name: plakophilin 1
  Uniprot ID: Q13835
  ENST ID: ENST00000352845
  CDS Start-End: 1-2244
atgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaa

SEQ ID NO: 166307 - DNA, 5384 bp, Homo sapiens
  Payload ID: 12745
  Gene Symbol: PKP1
  Gene Name: plakophilin 1
  Uniprot ID: Q13835
  ENST ID: ENST00000367324
  CDS Start-End: 252-2432
gggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaacttt

SEQ ID NO: 166308 - DNA, 2616 bp, Homo sapiens
  Payload ID: 12745
  Gene Symbol: PKP1
  Gene Name: plakophilin 1
  ENST ID: ENST00000622031
  CDS Start-End: 192-2369
agagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatccgccatctcctgcaacaagacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggg

SEQ ID NO: 166309 - DNA, 4241 bp, Homo sapiens
  Payload ID: 12746
  Gene Symbol: PKP2
  Gene Name: plakophilin 2
  Uniprot ID: Q99959
  ENST ID: ENST00000070846
  CDS Start-End: 26-2671
cagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagca

SEQ ID NO: 166310 - DNA, 4302 bp, Homo sapiens
  Payload ID: 12746
  Gene Symbol: PKP2
  Gene Name: plakophilin 2
  Uniprot ID: Q99959
  ENST ID: ENST00000340811
  CDS Start-End: 110-2623
ggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaa

SEQ ID NO: 166311 - DNA, 2644 bp, Homo sapiens
  Payload ID: 12746
  Gene Symbol: PKP2
  Gene Name: plakophilin 2
  ENST ID: ENST00000613243
  CDS Start-End: 1-2475
atggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactga

SEQ ID NO: 166312 - DNA, 1563 bp, Homo sapiens
  Payload ID: 12746
  Gene Symbol: PKP2
  Gene Name: plakophilin 2
  ENST ID: ENST00000546741
  CDS Start-End: 1-110
gcggccgcggcggccagacagtcaagagcctgcggatccaggagcaggtgcagcagaccctcgcccggaagggccgcagctccgtgggcaacggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatattcttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagtgacccaaaagaatggctaatatattatggagtttagaagtgtaaattggctgggcgcagtgactcatgcctgtaattgcagcactttgggaggccgaggcgggaggatcacctgaggtcgggagtttgagaccagcctgaccaacatggtaaaatcccatctctactaaaaatacaaaattagccgggcgtggtggcacatgccggtaatcccagctactcagctactcggaaggctgaggcaggagaatcgcttgaacccgggaggtagaagttgcagtgagcggagatctcgccattgcactccagcctgagcaacaagagcgaaacgccatctcaaaaaaaaaaaaaaaaaaaaaaaaagtaagttactcctggtggcaggaaattttgaaaagcttcctggaggtagatctcaaaaattcagtaggactggacatagggaggtgactggagaaagatcattctaggagggaacagaatgaatatttcacagttcacagagttgatatggtagaacaaagggcactatcttggtccttctgctataatgcttgggtcaactacttgactggctgttccaactaaggaacaaagcgtttgaaatattttgattgcaacagcagctttccagtaagctgaaatacactctgcagcctacacagaagtacaaatcagacagagagataaggcagcaaacaacacctacttactttaaagcctcagctttctaagactcaaaaaggaaatcagcttcaaaggaatttaacattagcatgccatgaaacaattaccaggggtggttcgtatgtattgtttaattaaacttctttgaaaaggtctgggggctcgtggtggttctgagtataatttttattatttccatgttactatcctgtctctcaagttgaaacagacaagcaattgttgaaacagtgctggtctggaaaaaatcctgtatcaaca

SEQ ID NO: 166313 - DNA, 2809 bp, Homo sapiens
  Payload ID: 12747
  Gene Symbol: PKP3
  Gene Name: plakophilin 3
  Uniprot ID: Q9Y446
  ENST ID: ENST00000331563
  CDS Start-End: 77-2470
ggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccgggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgacttccgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtca

SEQ ID NO: 166314 - DNA, 940 bp, Homo sapiens
  Payload ID: 12747
  Gene Symbol: PKP3
  Gene Name: plakophilin 3
  ENST ID: ENST00000528036
  CDS Start-End: 472-940
ctcagggctgggcaggcgtctgtcttcaggcggctctggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactca

SEQ ID NO: 166315 - DNA, 756 bp, Homo sapiens
  Payload ID: 12747
  Gene Symbol: PKP3
  Gene Name: plakophilin 3
  ENST ID: ENST00000534401
  CDS Start-End: 15-756
gcgccgggccagggatggagtcctggacacctcggccgtcagcagtggcctctgggatgagctgggaggctggcgggatccggaccacgagccggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccg

SEQ ID NO: 166316 - DNA, 1111 bp, Homo sapiens
  Payload ID: 12747
  Gene Symbol: PKP3
  Gene Name: plakophilin 3
  ENST ID: ENST00000533249
  CDS Start-End: 519-1111
cctggggtgcaggagcagtggtgccagggtcccagaagccagagagggttttggaggcctctgtagggggtgagggggtcctggggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaa

SEQ ID NO: 166317 - DNA, 687 bp, Homo sapiens
  Payload ID: 12747
  Gene Symbol: PKP3
  Gene Name: plakophilin 3
  ENST ID: ENST00000531857
  CDS Start-End: 51-687
agttgggtttggaggcggccgccaggcccaggcccggtggacctgccgccatgcaggacggtaacttcctgctgtcggccctgcagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccg

SEQ ID NO: 166318 - DNA, 847 bp, Homo sapiens
  Payload ID: 12747
  Gene Symbol: PKP3
  Gene Name: plakophilin 3
  ENST ID: ENST00000527442
  CDS Start-End: 488-847
gcagtggtgccagggtcccagaagccagagagggttttggaggcctctgtaggggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggct

SEQ ID NO: 166319 - DNA, 495 bp, Homo sapiens
  Payload ID: 12747
  Gene Symbol: PKP3
  Gene Name: plakophilin 3
  ENST ID: ENST00000525642
  CDS Start-End: 1-347
attttgacggactccgaaagctcatcttcatcaagaagaagcgggacagccccgacagtgagaagtcctcccgggcagcatccagcctcctggccaacctgtggcagtacaacaagctccaccgtgacttccgggcggtacgtttcccgagcccagggcaagcagggacccgggtgcagggcatgggacgccgggggagggtcagtgaagaggcccatgggaggatggagaccagggacccagagaggaagggtccgggccacacccagcacactgcaggagggacagcgggcagagggccacatgggcagacatgcaccctgaccttgggcctctctccactgtagaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccc

SEQ ID NO: 166320 - DNA, 5777 bp, Homo sapiens
  Payload ID: 12748
  Gene Symbol: PKP4
  Gene Name: plakophilin 4
  Uniprot ID: Q99569
  ENST ID: ENST00000389757
  CDS Start-End: 126-3575
ggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaattatgatcttgttgagtaattcctggattaggaatggggtaggggaaagaagccccacagtagggtaggcagaggtccccatagcaccacacagcattacttgggagcttttctccatctgtggaggcaatgagggacaccaggcccaaagtctgaggccttctcaggtcttgcagtttccacccttcagtcctagctcctggatctttgttggtgtaaatatggaaatgccacattggttaagtgccatcatggaaaactaggaactagtttacctgtagctgtactaggaaaactaggaactaacgcccatggcaagtcaaacccagaagtgttgtcttagctcaatataccctgcaagtgtaatacaaatcgcagattaaaacatttgtacttatatttgtgagtatatggaaagacacccaagagaaaactgcgttttcttgccgaatggacagcagcccaagatgagcatccaaagtgaaatggaaataccagtgcgagcatgaaagttcctaagatctgcaagccgggagcccttctggggtgccttctgaagaacactcgagccagcttgcggagtcgactgcccagctactgagccctggctgcctcatacctggcggagctcagcagacagcccttgttagatggcagaggtcgccagatgttcctgaggaactggcatcaggacttctgggacgtaaccacttcagtttccaatcactgacttccctgaacctggtatcttcagatctgggttgaagctgaaggctcagttggggaatcaggaaaacaagggaatcggagccagcccaagccaactgacaataactttcttttagtgactgcattagtttggggtaatgctgtaacaggcagcatttcaaaaacggatccaaatttgggttgaaaataactcacctgggtctccaatcagacctaacagagccagaaagaggcctgtacacggggactgggcagaagatctaatgccgtttaagactcctcccttgagaccagagaaaagaaactgcagacacagcctga

SEQ ID NO: 166321 - DNA, 4443 bp, Homo sapiens
  Payload ID: 12748
  Gene Symbol: PKP4
  Gene Name: plakophilin 4
  Uniprot ID: Q99569
  ENST ID: ENST00000389759
  CDS Start-End: 113-3691
gcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaa

SEQ ID NO: 166322 - DNA, 520 bp, Homo sapiens
  Payload ID: 12748
  Gene Symbol: PKP4
  Gene Name: plakophilin 4
  ENST ID: ENST00000457109
  CDS Start-End: 111-272
gccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggtgtttacatccctgagtacattgggatgactggcatgtagagccgctccaggtgccagtcagaatcggaacatgcaggatacttgtgcgtctgcaagagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagag

SEQ ID NO: 166323 - DNA, 552 bp, Homo sapiens
  Payload ID: 12748
  Gene Symbol: PKP4
  Gene Name: plakophilin 4
  ENST ID: ENST00000411900
  CDS Start-End: 89-376
tttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagtatcttgtgttactcatgggcaaaaaaacttcttagtgaatagaattctgtctgttgtttctgattgttggtatgaacattaaactattgggctgatcttgctggtttgaagcagctttctgaagtagctcaacagttgccacccccttgagcagtagctacaaagagacaagcttagaaatttgccttctatcagcaagagaccattgtgcgtaacta

SEQ ID NO: 166324 - DNA, 3099 bp, Homo sapiens
  Payload ID: 12748
  Gene Symbol: PKP4
  Gene Name: plakophilin 4
  ENST ID: ENST00000421462
  CDS Start-End: 859-1509
ttgcttttcccggcgattcctctccccggtctcccgtacgcgcagcgcacgacctctgcccacgctgggctgttcggattcagagctcccagccccgaacttgagcgccgcgctgagccctgctggacgccctcgcggcggcttccccgctgcctgccgccgcgcgccccaagtcgccctcgacaccactgggcgcccgccctcctcagcactcggggccggctgtctgtccttctagccccagatcctgcaccttggtcccctccccgtcttcccacgcccctgctgcccgcgcggtcttgcgtttgtccccgaagtcctgtactccttgccggtcctgcccacccctctgcctagtgcgcccctctctaccggccgcggatcctcacgctccacccctcccggctccccagcgccgagcctcgccgctgccctcctgcgccgccgcttcctcctctccctgccaggagttgaagcggagctgcggcacctccctggcggatctggtatccccgcccgctgccgaggctgccggccctctcccctggaccgctacccggagagcgagcggcggggccgggatttggctgcgtgttggctgagtgcgacacaccgcgagcgcgggcagtggaggtgccgcggcggccgtggccgctcggggcgcagcggtagtcaggtgtgtgtgtacagcgggggacgcgcgctgccggctcctgggctggcgacagattgtgcaggaatgcgaggaatgcaccaggggcagagtccacacagcccgccgcggctgccctagcgccttccctccccagctctcgccgcgcagccagaggtcaccggagcatcttcggagctggaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactagg

SEQ ID NO: 166325 - DNA, 4134 bp, Homo sapiens
  Payload ID: 12748
  Gene Symbol: PKP4
  Gene Name: plakophilin 4
  ENST ID: ENST00000426248
  CDS Start-End: 261-911
tccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaa

SEQ ID NO: 166326 - DNA, 2359 bp, Homo sapiens
  Payload ID: 12748
  Gene Symbol: PKP4
  Gene Name: plakophilin 4
  ENST ID: ENST00000452162
  CDS Start-End: 92-232
aattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaa

SEQ ID NO: 166327 - DNA, 884 bp, Homo sapiens
  Payload ID: 12748
  Gene Symbol: PKP4
  Gene Name: plakophilin 4
  ENST ID: ENST00000481115
  CDS Start-End: 1-500
gatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgca

SEQ ID NO: 166328 - DNA, 3856 bp, Homo sapiens
  Payload ID: 12748
  Gene Symbol: PKP4
  Gene Name: plakophilin 4
  ENST ID: ENST00000628904
  CDS Start-End: 128-3754
gaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccggggccgtccgaaaagaaaagggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagt

SEQ ID NO: 166329 - DNA, 162 bp, Homo sapiens
  Payload ID: 12748
  Gene Symbol: PKP4
  Gene Name: plakophilin 4
  ENST ID: ENST00000629219
  CDS Start-End: 1-162
atgccagctcctgagcaggcctcattggtggaggaggggcaaccacagacccgccaggaagctgcctccactggcccaggcatggaacccgagaccacagccaccactattctagcatccgtgaaggagcaggtgtttacatccctgagtacattgggatga

SEQ ID NO: 166330 - DNA, 2305 bp, Homo sapiens
  Payload ID: 12749
  Gene Symbol: PLVAP
  Gene Name: plasmalemma vesicle associated protein
  Uniprot ID: Q9BX97
  ENST ID: ENST00000252590
  CDS Start-End: 63-1391
cgggggccagagcaggcctggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcctcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaagac

SEQ ID NO: 166331 - DNA, 272 bp, Homo sapiens
  Payload ID: 12749
  Gene Symbol: PLVAP
  Gene Name: plasmalemma vesicle associated protein
  ENST ID: ENST00000595816
  CDS Start-End: 1-160
gagtgagaagcaatgcagagatcaattcaaggacatgaacaagagctgcgatgccttgctcttcatgctgaatcagaaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttcaaag

SEQ ID NO: 166332 - DNA, 620 bp, Homo sapiens
  Payload ID: 12749
  Gene Symbol: PLVAP
  Gene Name: plasmalemma vesicle associated protein
  ENST ID: ENST00000599426
  CDS Start-End: 55-620
agagcaggcctggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaagctccaagctgaatgctcccggcagacccagctagcgctggagga

SEQ ID NO: 166333 - DNA, 2741 bp, Homo sapiens
  Payload ID: 12750
  Gene Symbol: PLG
  Gene Name: plasminogen
  Uniprot ID: P00747
  ENST ID: ENST00000308192
  CDS Start-End: 64-2496
atgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctggaacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggtttt

SEQ ID NO: 166334 - DNA, 1166 bp, Homo sapiens
  Payload ID: 12750
  Gene Symbol: PLG
  Gene Name: plasminogen
  ENST ID: ENST00000366924
  CDS Start-End: 68-478
tctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaggttagaactctcatcacatgttcgactcaaattgtggagcaaaagagtaaataagatataaaaatgaaaatgaagatacgtgaaa

SEQ ID NO: 166335 - DNA, 558 bp, Homo sapiens
  Payload ID: 12750
  Gene Symbol: PLG
  Gene Name: plasminogen
  ENST ID: ENST00000418964
  CDS Start-End: 60-558
aagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcaggtatttccattgtcgttgcacctacgcaggaatctgtaattcagatggcaaggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggaga

SEQ ID NO: 166336 - DNA, 2706 bp, Homo sapiens
  Payload ID: 12751
  Gene Symbol: PLAT
  Gene Name: plasminogen activator, tissue
  Uniprot ID: P00750
  ENST ID: ENST00000220809
  CDS Start-End: 258-1946
gaacttcctccccctgctttataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaa

SEQ ID NO: 166337 - DNA, 2516 bp, Homo sapiens
  Payload ID: 12751
  Gene Symbol: PLAT
  Gene Name: plasminogen activator, tissue
  Uniprot ID: P00750
  ENST ID: ENST00000352041
  CDS Start-End: 210-1760
atggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 166338 - DNA, 2599 bp, Homo sapiens
  Payload ID: 12751
  Gene Symbol: PLAT
  Gene Name: plasminogen activator, tissue
  Uniprot ID: P00750
  ENST ID: ENST00000429089
  CDS Start-End: 151-1839
agagctgagatcctacaggagtccagggctggagagaaaacctctgcgaggaaagggaaggagcaagccgtgggagggagagaggaagggagggagggaagacgaaaacacgccgaggtcccagaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaa

SEQ ID NO: 166339 - DNA, 1655 bp, Homo sapiens
  Payload ID: 12751
  Gene Symbol: PLAT
  Gene Name: plasminogen activator, tissue
  ENST ID: ENST00000429710
  CDS Start-End: 99-1409
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctct

SEQ ID NO: 166340 - DNA, 670 bp, Homo sapiens
  Payload ID: 12751
  Gene Symbol: PLAT
  Gene Name: plasminogen activator, tissue
  ENST ID: ENST00000520523
  CDS Start-End: 135-670
aaaaaaaaaaaaggacatgctacagcatggatgcaccttgaagacatttgcaaagtgaaacaaaccagtcgcaaaagaagaaacactgtctcattccacttctaggataatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactg

SEQ ID NO: 166341 - DNA, 2030 bp, Homo sapiens
  Payload ID: 12751
  Gene Symbol: PLAT
  Gene Name: plasminogen activator, tissue
  ENST ID: ENST00000519510
  CDS Start-End: 99-1598
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtata

SEQ ID NO: 166342 - DNA, 1613 bp, Homo sapiens
  Payload ID: 12751
  Gene Symbol: PLAT
  Gene Name: plasminogen activator, tissue
  ENST ID: ENST00000524009
  CDS Start-End: 99-1520
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaataggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttct

SEQ ID NO: 166343 - DNA, 604 bp, Homo sapiens
  Payload ID: 12751
  Gene Symbol: PLAT
  Gene Name: plasminogen activator, tissue
  ENST ID: ENST00000521042
  CDS Start-End: 1-290
gatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaa

SEQ ID NO: 166344 - DNA, 549 bp, Homo sapiens
  Payload ID: 12751
  Gene Symbol: PLAT
  Gene Name: plasminogen activator, tissue
  ENST ID: ENST00000521694
  CDS Start-End: 78-549
agttttgagaaacaggaaatttgaggaaagctgagaaagagaagatctggaaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggccc

SEQ ID NO: 166345 - DNA, 2321 bp, Homo sapiens
  Payload ID: 12752
  Gene Symbol: PLAU
  Gene Name: plasminogen activator, urokinase
  Uniprot ID: P00749
  ENST ID: ENST00000372764
  CDS Start-End: 94-1389
gcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatga

SEQ ID NO: 166346 - DNA, 2658 bp, Homo sapiens
  Payload ID: 12752
  Gene Symbol: PLAU
  Gene Name: plasminogen activator, urokinase
  ENST ID: ENST00000446342
  CDS Start-End: 483-1727
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacaggcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatg

SEQ ID NO: 166347 - DNA, 468 bp, Homo sapiens
  Payload ID: 12752
  Gene Symbol: PLAU
  Gene Name: plasminogen activator, urokinase
  ENST ID: ENST00000481390
  CDS Start-End: 150-468
agcaatcagcatgacagcctccagccaagtaatctggagtcatgagagctgctaggggagcaacatgaatcatgacggtccctgggaatttcctgataactaacctgggagtttcgggagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgccc

SEQ ID NO: 166348 - DNA, 1610 bp, Homo sapiens
  Payload ID: 12753
  Gene Symbol: PLAUR
  Gene Name: plasminogen activator, urokinase receptor
  Uniprot ID: Q03405
  ENST ID: ENST00000221264
  CDS Start-End: 428-1300
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgg

SEQ ID NO: 166349 - DNA, 1548 bp, Homo sapiens
  Payload ID: 12753
  Gene Symbol: PLAUR
  Gene Name: plasminogen activator, urokinase receptor
  Uniprot ID: Q03405
  ENST ID: ENST00000340093
  CDS Start-End: 231-1238
cagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgg

SEQ ID NO: 166350 - DNA, 1254 bp, Homo sapiens
  Payload ID: 12753
  Gene Symbol: PLAUR
  Gene Name: plasminogen activator, urokinase receptor
  Uniprot ID: Q03405
  ENST ID: ENST00000339082
  CDS Start-End: 47-892
agagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctgga

SEQ ID NO: 166351 - DNA, 740 bp, Homo sapiens
  Payload ID: 12753
  Gene Symbol: PLAUR
  Gene Name: plasminogen activator, urokinase receptor
  ENST ID: ENST00000599546
  CDS Start-End: 505-740
cggagacagaacttcgcgggaaactagagtatctaacaatagaaactccggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaagacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttgcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccga

SEQ ID NO: 166352 - DNA, 742 bp, Homo sapiens
  Payload ID: 12753
  Gene Symbol: PLAUR
  Gene Name: plasminogen activator, urokinase receptor
  ENST ID: ENST00000599892
  CDS Start-End: 65-742
ttggagagctggagggcggagacagaacttcgcgggaaactagacctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcac

SEQ ID NO: 166353 - DNA, 715 bp, Homo sapiens
  Payload ID: 12753
  Gene Symbol: PLAUR
  Gene Name: plasminogen activator, urokinase receptor
  ENST ID: ENST00000593447
  CDS Start-End: 1-401
gccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaa

SEQ ID NO: 166354 - DNA, 679 bp, Homo sapiens
  Payload ID: 12753
  Gene Symbol: PLAUR
  Gene Name: plasminogen activator, urokinase receptor
  ENST ID: ENST00000602141
  CDS Start-End: 222-679
ggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcgcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctc

SEQ ID NO: 166355 - DNA, 842 bp, Homo sapiens
  Payload ID: 12753
  Gene Symbol: PLAUR
  Gene Name: plasminogen activator, urokinase receptor
  ENST ID: ENST00000597107
  CDS Start-End: 22-162
cacaggagctgccctcgcgacatgggtcacccgccgctgctgccgctgctgctgctgctccacacctgcgtcccagcctgggcgacagcgcgagactccatttcaaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaa

SEQ ID NO: 166356 - DNA, 555 bp, Homo sapiens
  Payload ID: 12753
  Gene Symbol: PLAUR
  Gene Name: plasminogen activator, urokinase receptor
  ENST ID: ENST00000593714
  CDS Start-End: 1-555
cctcttggggcctgcggtgcatgcagtgtaagaccaacggggattgccgtgtggaagagtgcgccctgggacaggacctctgcaggaccacgatcgtgcgcttgtgggaaggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacg

SEQ ID NO: 166357 - DNA, 1205 bp, Homo sapiens
  Payload ID: 12753
  Gene Symbol: PLAUR
  Gene Name: plasminogen activator, urokinase receptor
  ENST ID: ENST00000601723
  CDS Start-End: 34-894
agggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaaaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgga

SEQ ID NO: 166358 - DNA, 897 bp, Homo sapiens
  Payload ID: 12753
  Gene Symbol: PLAUR
  Gene Name: plasminogen activator, urokinase receptor
  ENST ID: ENST00000593939
  CDS Start-End: 441-897
cggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaagacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaag

SEQ ID NO: 166359 - DNA, 607 bp, Homo sapiens
  Payload ID: 12753
  Gene Symbol: PLAUR
  Gene Name: plasminogen activator, urokinase receptor
  ENST ID: ENST00000595038
  CDS Start-End: 1-463
ctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttca

SEQ ID NO: 166360 - DNA, 932 bp, Homo sapiens
  Payload ID: 12754
  Gene Symbol: PLGRKT
  Gene Name: plasminogen receptor, C-terminal lysine transmembrane protein
  Uniprot ID: Q9HBL7
  ENST ID: ENST00000223864
  CDS Start-End: 223-666
gagcgaggcccggtccctgcagcgggcgaaaggagcccgggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcagattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctgg

SEQ ID NO: 166361 - DNA, 1169 bp, Homo sapiens
  Payload ID: 12755
  Gene Symbol: PLGLB1
  Gene Name: plasminogen-like B1
  Uniprot ID: Q02325
  ENST ID: ENST00000355705
  CDS Start-End: 70-360
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcaaacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaa

SEQ ID NO: 166362 - DNA, 960 bp, Homo sapiens
  Payload ID: 12755
  Gene Symbol: PLGLB1
  Gene Name: plasminogen-like B1
  Uniprot ID: Q02325
  ENST ID: ENST00000409310
  CDS Start-End: 70-360
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaaggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtattctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctca

SEQ ID NO: 166363 - DNA, 553 bp, Homo sapiens
  Payload ID: 12755
  Gene Symbol: PLGLB1
  Gene Name: plasminogen-like B1
  Uniprot ID: Q02325
  ENST ID: ENST00000409801
  CDS Start-End: 70-360
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcaaacctagattctcacctgctacacacccctcagagggactggaggaatccagacaacgatgcgcaggggccctggtgctatact

SEQ ID NO: 166364 - DNA, 558 bp, Homo sapiens
  Payload ID: 12755
  Gene Symbol: PLGLB1
  Gene Name: plasminogen-like B1
  ENST ID: ENST00000409795
  CDS Start-End: 70-339
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatgggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcaaacctagattctcacctgctacacacccctcagagggactgg

SEQ ID NO: 166365 - DNA, 1173 bp, Homo sapiens
  Payload ID: 12756
  Gene Symbol: PLGLB2
  Gene Name: plasminogen-like B2
  Uniprot ID: Q02325
  ENST ID: ENST00000359481
  CDS Start-End: 68-358
tctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaa

SEQ ID NO: 166366 - DNA, 522 bp, Homo sapiens
  Payload ID: 12756
  Gene Symbol: PLGLB2
  Gene Name: plasminogen-like B2
  Uniprot ID: Q02325
  ENST ID: ENST00000410086
  CDS Start-End: 55-345
aacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctagattctcacctgctacacacccctcagagggactggaggaatccagacaacgatgcgcaggg

SEQ ID NO: 166367 - DNA, 1512 bp, Homo sapiens
  Payload ID: 12757
  Gene Symbol: PLLP
  Gene Name: plasmolipin
  Uniprot ID: Q9Y342
  ENST ID: ENST00000219207
  CDS Start-End: 148-696
caggctcccagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaatta

SEQ ID NO: 166368 - DNA, 665 bp, Homo sapiens
  Payload ID: 12757
  Gene Symbol: PLLP
  Gene Name: plasmolipin
  ENST ID: ENST00000569059
  CDS Start-End: 133-507
gacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgc

SEQ ID NO: 166369 - DNA, 449 bp, Homo sapiens
  Payload ID: 12757
  Gene Symbol: PLLP
  Gene Name: plasmolipin
  ENST ID: ENST00000564018
  CDS Start-End: 176-449
atcgaagccagacagctgggctccagagttcatgctgttagccactacccatgctctgctgggatggtcaggcccatcctgccgtgtgggaacagcctgacaggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttca

SEQ ID NO: 166370 - DNA, 7578 bp, Homo sapiens
  Payload ID: 12757
  Gene Symbol: PLLP
  Gene Name: plasmolipin
  ENST ID: ENST00000613167
  CDS Start-End: 122-607
cagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcggtgcttgtaacctccaggagacctcagcttgactgtagaagatgcctgctgtagggcagttcacgttctggagtcgttcagcaccacctgcgaactctttgaccggaggaaggctgcctatacttcctgcttgctgggtctggaacagtcctggtttatgctgtttgtgctggcataaatagaatagcacggccttttattctcacaagtgactcagtttgacaataacttagtcacccttgctttgggcaggttaggtgagcttactgaatcaaagatttcaacaatatcatctaccttgaaagtctgtgaagcttggaggtcatataatcaaggtggctggccatgctgcctgctcagagctggtagagacagcagaggaaagcagctgagtactcctgagcttatttttccaacaccacagaacaacgttctctgaacaataaggtaaaagcatttctaggtaccctctgtacccttttgttattttttatttttattttttggagaccgagtcttgctctagtgcccaggctggagtgcaatggcgcaatcttggctcactgcaatctccgccttctgggttcaagcaattctcctgcctcagcctcctgagtagctgagactacaggtgagcgccaccacgcccagctgattttttgtatttttagtagagatggggtttcaccatgttagccaggatggtcttgatctcctgacttcatgatccgcctgccttagcctcccaaagtgctgggattacaggtgtgagccaccacacctggccgattttttttttttttaagagacagggtcttgctctcttgcccaggttggagtacagtgccacaactacagctcactgcagccttgactgcccaggctcaagcaatcctcccacctcagcttcctcagtagcttggactacaagtgcaggccaccatgcccagctaatttttgtttttttttttttttgagatggagtctcactttgtcacccaggctggactgcagtggcgtgatctcggctcactgcaacctctgcctcccagattcaagcgattctcctgcctcagcctcccgagtaacggactacaggtgcgtgccaccatgcctggctaatgttttgtatttttagtagagacggggtttcaccgtgttagccaggatggtctcgatctcctgacctcgtgatccgcccgtctcggcctcccaaagtgctgggattaccagcgtgagccactgtgcccggctgatttttaaattttttgtagacattgggtctcgctatattgcttaggctggtcttaaactcccagcttcaagtgatcctcccatctcagcctcccaaagcgctgagattatcggcatgaaccaccacacttggccctggtataaatattaatagcatcactttttactctaaagtctcggagtttgaataataaattagtccttccaggagtaagttataagagtttggttttaaggaagggcaatacacttaaatgtaaaacaaaatcccaggcaagttagagagctcacccctcttatgtttccaacatgaatcaaaagcctgtttcaggggggacattaaaggcattcagtcaatgctaaggctcagcagtttgtgtgactactgcttcccactggggaggagtcctaagcaagaggactggggcttcctcaccccagggcaggtgggagccccatcaaaggtggcacctgacatcacagtctaagtgtctgaggatggagagacaggctgctagtttattttaaaagaaatcagaatgtctacttataatattaagtgacaacagacttgcctcctttttgctgagcagaaagggtgaaaaaaccagccaggcatggtggctcacacctgtgatcccagcactttgggaggtgggtgatcacctgaagtcaggagttcaagaccagcctgaccaacatggtgaaaccctgtctctactaaaaatacaaaaattagctgggcgtgtttgtggacacctataatcccggctgcttgggaggctgaggcagcagaatcactggaactcgggaggtggaggttgcagtgtgccgagatcgtgccattgcactccagcctgggcaacaaaagcaaaactccattcccaaaaaaaaaagaaaaaaaaaagggtgaaaaaccaatttgcctttatcatcgttttttcatcatttaatctctggacttgtccactggccttttctcaagtaggcaggctggtccacaggtcttagcaagtgctcccagcatgcctgggctgtggtggacctcccatttatagacaaagcaagggaaagcaagcccaggagaggtggcatttaaaaaaaaaaaaaaaagaccaaagcaataattaataaccttatggcagtggctacattaaagaaagaatacaactcattgagaatggtggttcttgcgaaacacctgaagttttactcatggtacaaaagtatttaataagtgacacatcagtacagaaacacagagcttgtagcttgtcctttaaaaccagaatggccaagtgaaaagtcagtacagattcttatttttactattaaaaaaaaaaaatcaaagggacacactgggaattgaactactatgctttttcttcgttctagagatgacatatatgttttctgataagtaatctaccacacattgcactaaaccaaagcatacaaacagccagtaaagctgtgctctacctgctactcatgctgggctggacagtggaacaccatcttggtaggagagattttgacaggaagaaactgcagagtccctacctaacccagagaaccttacaaactggtttatacacaaaggattttcagcaaacatgcaaacacactaacatgctataggaatatgttttagtctatttctagcacacagcatacattcataggtgcccagtaaaataggaatgaatgtcaatgtagaaagcatttttgccttcacagtactaacaaacacctaaaaagcacacagcatataatactttgatctttaagtggataatcatggaagttccaagatcacatccactaggttagcctgagtattcatctataaaaatattttttttttcaaaaataatgcttaaaagagacttctagaaacagtgggactacatcaggaccagaagacagtgacacaaggactgcaaatgttaagactaggagtagcttttcacatggagcttttatgtagaggacgtctccttctgttgattcctacagccgagacaagatgtgatcacaggagactccaaaatctcaaactgggcttgagtaacaccctagataaacatcaggaaccccactgaggctgaagtactgaaactgtggcccatgtgaaaaagaggtgcaagtgcacaaagattcatgcagagcctgctggaacagagggtggtggcggcgggttagtccacacttacacaccagcaggtatgctggggaagggccccccaggtggagtgcctgacatagggctcgctccagaggcgtctgactcagaagctcctgagagaggtgtctacttgaggtggggaggagtactatggttaatgaatacaagaaggtgtttcaggataaataggtccaggagggttaggtcattttggttttgacctattaatacttaacataaatgaagagttacataacagagtcagtctttccaagatgtgttctgtcatcatgagctgagcctattgggctggtgacatccagaatgatcccattcattggctggaggtaggacctagtgccgcagattgttctgggaagctggcagagaagatgatttgcacaatgaagtcaccactaagccactgcttaagtccagtcctcggccttctttttcctatatgagaaaacaaccaaaggaaggactagaaagagccctggcttggaatcttgcctctgacatggggaaggcagagctgaaggtgggaacgtggacctccagagtacataggaagggaacacaggttattggttattctgcatttctgctcaatactggcctgccctagtcttaattttttttaatattatttttaaagaggtagggtcttgctctgtcacccaggctggagtatagtggcttgatcacagctaactgctgcctggaattcctgggctcaagtggtcctcctgcctcagcctcctgagtagctaggactacaggtgtgcaccactacagctgactaacttttttatttttatttttgtagagacagggtcttgatatgtcacttaggctggtcttgaactcctgggctcaagtgattctcctgccttggcctcccaaagcgctggaattgtaagtatgagccactgtgtccagcctggccctggtcattcttaaaatgcactcttaaaatgtacctcccttcactggaaaacatttttctttctttctttttttttttttttgagataggggtcttgctatgttgcccaggctggagtgcagtggctattcacaggcaccactgctgtgtaatacagccccaaactcctaggctcaagtgattctcctgcctcagccttcgaagtagctgggactacaggcatgcacaaccacacccaacaccatttctttttcttttctttttttttttttgacacagggtctgactctgtcacccaggctggactgtagcagtacaatcacagctcacagcaatctcaaccttctgggctcaagcggtcctcccacccagcccccaaagtagctgactgggactacagatgcacaccagcacaccaagctaatttttgtatttttcatagagacagggttttgccatgttgccttggctggtctcaaactcctgagctcaagccatctgcctgcctcggcctcccaaagtgctgggattataggtgtgagttaccatgcccagtctcctatttttcttataaagagcttgcattatatgaaaagcaaggcagggccaggtgcggtggctcacgcctgtaatcccaacactttgggaggccgaggcggaccatgcttcaggagtttgagaccagcctggccaacatggtgaaaccctgtctctactaaaaatacaagaattagctgggcgtggtggcaggtgcctgtagtatcagctactcgggaggctgaggcaggagtattgcttgaacctggaaggcagaggttccagtgagccaagatggtgccactgcactccagcctgggtgacaagagcaaaactctgtctcaaaaaaaaaaataaataaaagaaaggcaaggcagaatgagacctgagacctgctttttcggttttgtccttctgattaggaactctaagttggtacctgggcttgtttcatgaaaacatgagaaggtcccagccacaacagaatagcagctcactcttctgatgcctcatcggccagtttgaagggagaatgatgggggaagcgtgggaggttcatgttcggtatttctacctggaattttctaagtggctcaaagtggctaaataaataggagtagtaacttactgctctgtagtccaaaaacatttctttaaaagccagaaaatctgtgaaggtgagcagcatgtcgaatatgtcaccagccacttcatccttatggtgcctgcaaacggaacagatggctgtttcgtgaatgaatgatgagacagtcctcaagattgctttcgtttttctttccaccaccccagccccaccccccgcattatttttgttttgtttttttagagactgggtcttgctctgtcacccaggcaggagtgcaggggtgcaattatagctcactgtagccttgaactgctgggctcaagggattctccagcctcagcctcctgagtagctaggcccacaggtatgcaacaccacacctgactaatttattttttgtagggtcggggcctcactatgtcacccaggctggtcttgaactcctgggctcaagtgatcctcctcccttggcctcccaaagcactgagaacacaagcgtgagccaatgcctgatcttttcaagatttcattaaaaggtttgagggcttcctccataggacctaaccaccaacggcatgcacaggaaaacaaacaaggagcgtcttttggtcagcctagggaaggaagaaagtgagaaaacaaaacaaaacacaaaaatcagtcaagctcaactcactgtaatgttgtggtgaaggctgccatgttgaactcaggaatccgctgcagcagctgttcttcaatgtatttttctaccaaagaaatctgcaacagtggaaaggattttggtgagaccatactttgggaaaacaagacttcttttcagaaagcctgcccagccctttctaaacatttcctgaggtctgtgtgccacaatctacactgagtgccaaggataccaaagaggaccaaaacacagctcctgtcctggagaagtactcagcctggtgtggaagagaagccttagctgataatggtgctgtaacagggtggatgctctgacacaggtggagacagtgagtagcacggtacccacacccacaacccagtgcaggatgcagtaagtgggggctttgcctcctgggtagagggcatctgtgtaacagaacatacggacatggaggcagtcacaggttccttctgggcaggtttgtttatgccatgcttctgtgttaagaaaataaagtcctggaggccaaaatggattcttagatgacagaatcccagggggctgttaagaggcctcagggtaaagtgtagagacccaagggtgacgagctgaggttcctgggttccagtcttggtttttccaccaaatagttagtgatcttggtctcagttttcacttttacttaatagtcatgcatatatgactggattatatagaagaaagaaagagtatgtgaaagcagaaaggtttgtcaaaagcatgcaaatgcaaggtatgaagaactcatgtactgtgattaaaagcaggattatgataagccaaa

SEQ ID NO: 166371 - DNA, 3755 bp, Homo sapiens
  Payload ID: 12758
  Gene Symbol: PLS1
  Gene Name: plastin 1
  Uniprot ID: Q14651
  ENST ID: ENST00000337777
  CDS Start-End: 214-2103
atcaagattaatatctgtagtaataggcagaacacttcagtgtggaattgcttcttttctttggtcaaacactaactttggcagaggatagacacagcttaggaagactgaattttaagtcttctgaattgtttttctggacttccaaatctcaagtgataagaccagcagaagcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatat

SEQ ID NO: 166372 - DNA, 3706 bp, Homo sapiens
  Payload ID: 12758
  Gene Symbol: PLS1
  Gene Name: plastin 1
  Uniprot ID: Q14651
  ENST ID: ENST00000457734
  CDS Start-End: 160-2049
atgcgcagtggcgcgagcgcagcggctacgcgggcgcggagaggtagccgcagagtggacctgcaggtacttggatctccagtgggagctgccctctcgaaggcaggacagcggtggcggcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaa

SEQ ID NO: 166373 - DNA, 580 bp, Homo sapiens
  Payload ID: 12758
  Gene Symbol: PLS1
  Gene Name: plastin 1
  ENST ID: ENST00000475296
  CDS Start-End: 222-580
gggcgcggagaggtagccgcagagtggacctgcaggtacttggatctccagtgggagctgccctctcgaaggcaggacagcggtggcggcagagacagagtctccctgtgttgcccaggctggtcttgaactcctggcctcaagcaatccacctgccttggcctcccaaagtgctgcaattacagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattctta

SEQ ID NO: 166374 - DNA, 1038 bp, Homo sapiens
  Payload ID: 12758
  Gene Symbol: PLS1
  Gene Name: plastin 1
  ENST ID: ENST00000476044
  CDS Start-End: 240-1038
agagtggacctgcaggtacttggatctccagtgggagctgccctctcgaaggcaggacagcggtggcggcagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgg

SEQ ID NO: 166375 - DNA, 635 bp, Homo sapiens
  Payload ID: 12758
  Gene Symbol: PLS1
  Gene Name: plastin 1
  ENST ID: ENST00000497199
  CDS Start-End: 478-635
aataggcagaacacttcagtgtggaattgcttcttttctttggtcaaacactaactttggcagaggatagacacagcttaggaagactgaattttaagtcttctgaattgtttttctggacttccaaatctcaagtgataagaccagcagaagcagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcg

SEQ ID NO: 166376 - DNA, 2258 bp, Homo sapiens
  Payload ID: 12758
  Gene Symbol: PLS1
  Gene Name: plastin 1
  Uniprot ID: Q14651
  ENST ID: ENST00000497002
  CDS Start-End: 321-2210
aattctccataggaacactatcaagtctttttccataaaagtcagataaaagaaagatcacatttcttgatattctttgaagcaactttatttttattgtcatgcttcatcctgcccgaatactgccaagtctttctcaggcacctggaatctgctcctcagcctctgttgtcctgggtctaatgtagagcaaaaggctgagaggaagctcttctattctccatcatcggtcttcagtggctacctgggaaacaccccttggcttagtcggcagattctctccgatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcaca

SEQ ID NO: 166377 - DNA, 564 bp, Homo sapiens
  Payload ID: 12758
  Gene Symbol: PLS1
  Gene Name: plastin 1
  ENST ID: ENST00000464320
  CDS Start-End: 204-564
acttggatctccagtgggagctgccctctcgaaggcaggacagcggtggcggcagccacggtgttggatacacttgtatgaggcttcagctgtgctgcataaatttcttgaagaacctgtgagccagaagcaaaatttcaggacagggggcacacactgaacttgaaatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttatt

SEQ ID NO: 166378 - DNA, 567 bp, Homo sapiens
  Payload ID: 12758
  Gene Symbol: PLS1
  Gene Name: plastin 1
  ENST ID: ENST00000461644
  CDS Start-End: 405-567
agtggacctgcaggtacttggatctccagtgggagctgccctctcgaaggcaggacagcggtggcggcagccacggtgttggatacacttgtatgaggcttcagctgtgctgcataaatttcttgaagaacctgtgagccagaagcaaaatttcaggacagggggcacacactgaacttgaagaaacattttccaagatgctaaaagtatggcttctactcatttttcccaaaaactgaagtaaaatgctaaaaagaatccatgtcatctgccagatttccaaaggctgtttttgagttcttctctaagatgttttcctccataaatgtgtacagcattaaagaagcccctgcagcatcttggagataatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgaga

SEQ ID NO: 166379 - DNA, 574 bp, Homo sapiens
  Payload ID: 12758
  Gene Symbol: PLS1
  Gene Name: plastin 1
  ENST ID: ENST00000495744
  CDS Start-End: 400-574
agccgcagagtggacctgcaggtacttggatctccagtgggagctgccctctcgaaggcaggacagcggtggcggcagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaa

SEQ ID NO: 166380 - DNA, 608 bp, Homo sapiens
  Payload ID: 12758
  Gene Symbol: PLS1
  Gene Name: plastin 1
  ENST ID: ENST00000483373
  CDS Start-End: 509-608
gcgggcgcggagaggtagccgcagagtggacctgcaggtacttggatctccagtgggagctgccctctcgaaggcaggacagcggtggcggcagagacagagtctccctgtgttgcccaggctggtcttgaactcctggcctcaagcaatccacctgccttggcctcccaaagtgctgcaattacagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgact

SEQ ID NO: 166381 - DNA, 2277 bp, Homo sapiens
  Payload ID: 12759
  Gene Symbol: PLS3
  Gene Name: plastin 3
  Uniprot ID: P13797
  ENST ID: ENST00000289290
  CDS Start-End: 227-2080
agtcgggccagacccaggactctgcgactttacatctttaaatggatgagatggctaccactcagatttccaaagatgagcttgatgaactcaaagaggcctttgcaaaagttgatcgttctacctcgccacgttaaattatagcttcagtataagatgagaaggcatagcatgctatttgatttatcctttatcatcatataacatgccttacaattgagcagctatggaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaagcttattgacttcagtaattcagtgaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcag

SEQ ID NO: 166382 - DNA, 3280 bp, Homo sapiens
  Payload ID: 12759
  Gene Symbol: PLS3
  Gene Name: plastin 3
  Uniprot ID: P13797
  ENST ID: ENST00000355899
  CDS Start-End: 88-1980
aaagattccgaggtgcagaagttgtctgagtgggttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttaccaaaa

SEQ ID NO: 166383 - DNA, 3150 bp, Homo sapiens
  Payload ID: 12759
  Gene Symbol: PLS3
  Gene Name: plastin 3
  ENST ID: ENST00000420625
  CDS Start-End: 1-1854
atgatagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaagcttattgacttcagtaattcagtgaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttacc

SEQ ID NO: 166384 - DNA, 568 bp, Homo sapiens
  Payload ID: 12759
  Gene Symbol: PLS3
  Gene Name: plastin 3
  ENST ID: ENST00000497870
  CDS Start-End: 1-568
tttcaagctgtgttttgtggagttgtccacacaacctgaattcatgttgactgattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaatta

SEQ ID NO: 166385 - DNA, 2858 bp, Homo sapiens
  Payload ID: 12759
  Gene Symbol: PLS3
  Gene Name: plastin 3
  ENST ID: ENST00000481823
  CDS Start-End: 89-217
agattgctcttctgggcgtgggagaaggttctgtctatcagtgctgcgagaaaggaaagaaacaagtttgctctcagcggatctttaaatggatgagatggctaccactcagatttccaaagatgagcttgatgaactcaaagaggcctttgcaaaagttgtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaag

SEQ ID NO: 166386 - DNA, 926 bp, Homo sapiens
  Payload ID: 12759
  Gene Symbol: PLS3
  Gene Name: plastin 3
  ENST ID: ENST00000489283
  CDS Start-End: 96-224
acagctgcaaagattccgaggtgcagaagttgtctgagtgggttggtcggcggcagtcgggccagacccaggactctgcgactttacatctttaaatggatgagatggctaccactcagatttccaaagatgagcttgatgaactcaaagaggcctttgcaaaagttgtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaa

SEQ ID NO: 166387 - DNA, 3037 bp, Homo sapiens
  Payload ID: 12759
  Gene Symbol: PLS3
  Gene Name: plastin 3
  Uniprot ID: P13797
  ENST ID: ENST00000539310
  CDS Start-End: 34-1926
aaagaaacaagtttgctctcagcggatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataa

SEQ ID NO: 166388 - DNA, 500 bp, Homo sapiens
  Payload ID: 12759
  Gene Symbol: PLS3
  Gene Name: plastin 3
  ENST ID: ENST00000473026
  CDS Start-End: 9-500
atctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatttatggccaaagccttttgttttgaattctatgttcaataaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcag

SEQ ID NO: 166389 - DNA, 216 bp, Homo sapiens
  Payload ID: 12759
  Gene Symbol: PLS3
  Gene Name: plastin 3
  ENST ID: ENST00000626746
  CDS Start-End: 88-216
aaagattccgaggtgcagaagttgtctgagtgggttggtcggcggcagtcgggccagacccaggactctgcgactttacatctttaaatggatgagatggctaccactcagatttccaaagatgagcttgatgaactcaaagaggcctttgcaaaagttgtggagacggagtttcaccgtgttagccaggatggtctcgatctcctgacctcgtga

SEQ ID NO: 166390 - DNA, 2987 bp, Homo sapiens
  Payload ID: 12760
  Gene Symbol: PDGFC
  Gene Name: platelet derived growth factor C
  ENST ID: ENST00000274071
  CDS Start-End: 413-565
cgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtaggaactatatccaagcatctggactggcatagaaaagaggagaaagaacatttaaaaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaa

SEQ ID NO: 166391 - DNA, 849 bp, Homo sapiens
  Payload ID: 12760
  Gene Symbol: PDGFC
  Gene Name: platelet derived growth factor C
  Uniprot ID: Q9NRA1
  ENST ID: ENST00000422544
  CDS Start-End: 1-849
atgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtccttcagttgagaccaaagaccggtgtcaggggattgcacaaatcactcaccgacgtggccctggagcaccatgaggagtgtgactgtgtgtgcagagggagcacaggaggatag

SEQ ID NO: 166392 - DNA, 4165 bp, Homo sapiens
  Payload ID: 12760
  Gene Symbol: PDGFC
  Gene Name: platelet derived growth factor C
  Uniprot ID: Q9NRA1
  ENST ID: ENST00000502773
  CDS Start-End: 492-1529
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaattatgtgtgtgtgtgctcaagatttatttcttggactctgagaaaatgaaagataaaattttctgttatgattttcatttagcaaaagcatatgtcaattcaaaagacaaaaaaagggaagatacctgtgagccttctctgcctcttgtttccaatgcctttgagcaatggttttatttttcttactggtcttaatacagatttctggtaatttaagtttcacctgacttgaaagttgtatggtttatgaaatgcttggtgataggtggtatggtagtatgaaactggaaaaaaacttgcaggtttccactcatgtcttcattgtcactggcaactactaaatggggtgagcataaattgatttggtgcatggattattgtacattgcacacttcaagatatggttcctcagttccagacatagattcctattcagggctggtatcttcagcatcctttcctcagcctttcaacttggcagagatgtctagtgtccagggccttctgtcttcagactgctcttcaggcaagcacccttttcctgtgctttgacacctgcagttctgccctgcctccaactatgtggaaaacaaagaaacaaaatgagcctatgtgttctgtcttacttccttaccttttcctggttttgtcctatccatatagaggccaactagatatatggaatatgcaacgtagtaagtagttggcagtttacaactttcattagtatagtaaagactactaagtcttagtaaatagcctgtttaactgtgtttaatccattgtttcccatctttgaacgaaatatattttcccttttttaatatttattttttgtttacttataaaatcttgacagccagaagagatcataagggtagcagtcctcagttgccagtcggtgagtggttaccatgtgaggactaaccactttataatcacttactcatagatcgtcctgtgtattttactaaacacacacacacacacacacacacataaatagcacatgaccctaatttctgagaagtacagtaagtattgactgtattgaccacacaccgttttgtgtatgatatctgtttcaagcctttgtccttgagacatgggctgttttgcccagtgatgtttactaaaataaaagcaagccttaaatgtca

SEQ ID NO: 166393 - DNA, 1014 bp, Homo sapiens
  Payload ID: 12760
  Gene Symbol: PDGFC
  Gene Name: platelet derived growth factor C
  ENST ID: ENST00000506880
  CDS Start-End: 1-161
ttacgtttgatgaaagatttgggcttgaagacccagaagatgacatatgcaagtatgattttgtagaagttgaggaacccagtgatggaactatattagggcgctggtgtggttctgggttctgcatccactacaacattgtcatgccaaacctcccgtgagttgttcctggcaggcatttgtgtctgcatgccctgtctgctgcttaggctctttaaaagatttgtgtgatacttgtttggttacttgtgtgattcataatagcagattctcgttttggcaagagaaaactctcttctatgatgcagtatacttggcttctcacaaagcaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctg

SEQ ID NO: 166394 - DNA, 4052 bp, Homo sapiens
  Payload ID: 12761
  Gene Symbol: PDGFD
  Gene Name: platelet derived growth factor D
  Uniprot ID: Q9GZP0
  ENST ID: ENST00000302251
  CDS Start-End: 453-1547
ggcagagcaggtttaggcccggcctgggaaactggggagctgaggtgctcgcgccgccgctctgagcccgagtgcgcgcctctcaggggccgcggccggggctggagaacgctgctgctccgctcgcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaa

SEQ ID NO: 166395 - DNA, 3801 bp, Homo sapiens
  Payload ID: 12761
  Gene Symbol: PDGFD
  Gene Name: platelet derived growth factor D
  Uniprot ID: Q9GZP0
  ENST ID: ENST00000393158
  CDS Start-End: 181-1293
acacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaacta

SEQ ID NO: 166396 - DNA, 620 bp, Homo sapiens
  Payload ID: 12761
  Gene Symbol: PDGFD
  Gene Name: platelet derived growth factor D
  ENST ID: ENST00000529268
  CDS Start-End: 1-620
atctttgaggccgtaggagcccagggaacagtggtcctcgatgaggagtcgctccatgtggatgatctggatctcttcgacggggactctggactccgcttcgcagaggaccttgaagtttcggagctcaaagtcggggctgacctggagagagaaggtgacctcggagaggtccctccgcacgcagtacacgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactggga

SEQ ID NO: 166397 - DNA, 4866 bp, Homo sapiens
  Payload ID: 12762
  Gene Symbol: PEAR1
  Gene Name: platelet endothelial aggregation receptor 1
  Uniprot ID: Q5VY43
  ENST ID: ENST00000292357
  CDS Start-End: 117-3230
ggctcgaagtggggaccctcgccccgtcctcggctgtccagtcctcctcctcgcagaccccggcggttcctaccccaggccgcaggggagacggggccccaaggcaggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtggggtatgttcttgcccttctggtctgcagcccccgaactgccttcagccctgtacccctggctactatggccctgcctgccagttccgctgccagtgccatggggcaccctgcgatccccagactggagcctgcttctgccccgcagagagaactgggcccagctgtgacgtgtcctgttcccagggcacttctggcttcttctgccccagcacccattcttgccaaaatggaggtgtcttccaaaccccacagggctcctgcagctgcccccctggctggatgggcaccatctgctccctgccctgcccagagggctttcacggacccaactgctcccaggaatgtcgctgccacaacggcggcctctgtgaccgattcactgggcagtgccgctgcgctccgggttacactggggatcggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatcctgtcagcctggccgctatggcaaacgctgtgtgccctgcaagtgcgctaaccactccttctgccacccctcgaacgggacctgctactgcctggctggctggacaggccccgactgctcccagccatgccctccaggacactggggagaaaactgtgcccagacctgccaatgtcaccatggtgggacctgccatccccaggatgggagctgtatctgccccctaggctggactggacaccactgcttagaaggctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtataactcgctgggtgcagtgattggcattgcagtgctggggtcccttgtggtagccctggtggcactgttcattggctatcggcactggcaaaaaggcaaggagcaccaccacctggctgtggcttacagcagcgggcgcctggacggctccgagtatgtcatgccagatgtccctccgagctacagtcactactactccaaccccagctaccacaccctgtcgcagtgctccccaaaccccccaccccctaacaaggttccaggcccgctctttgccagcctgcagaaccctgagcggccaggtggggcccaagggcatgataaccacaccaccctgcctgctgactggaagcaccgccgggagccccctccagggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaacgttg

SEQ ID NO: 166398 - DNA, 4970 bp, Homo sapiens
  Payload ID: 12762
  Gene Symbol: PEAR1
  Gene Name: platelet endothelial aggregation receptor 1
  Uniprot ID: Q5VY43
  ENST ID: ENST00000338302
  CDS Start-End: 226-3339
agtcaggctggggctcgaagtggggaccctcgccccgtcctcggctgtccagtcctcctcctcgcagaccccggcggttcctaccccaggccgcaggggagacggggccccaaggcaggcttcatatcctgaacgctgggatcccccaggacattccctggcccccaggccccaggtcccaggccccagggctgagctgtgggcaggccccacctggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtggggtatgttcttgcccttctggtctgcagcccccgaactgccttcagccctgtacccctggctactatggccctgcctgccagttccgctgccagtgccatggggcaccctgcgatccccagactggagcctgcttctgccccgcagagagaactgggcccagctgtgacgtgtcctgttcccagggcacttctggcttcttctgccccagcacccattcttgccaaaatggaggtgtcttccaaaccccacagggctcctgcagctgcccccctggctggatgggcaccatctgctccctgccctgcccagagggctttcacggacccaactgctcccaggaatgtcgctgccacaacggcggcctctgtgaccgattcactgggcagtgccgctgcgctccgggttacactggggatcggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatcctgtcagcctggccgctatggcaaacgctgtgtgccctgcaagtgcgctaaccactccttctgccacccctcgaacgggacctgctactgcctggctggctggacaggccccgactgctcccagccatgccctccaggacactggggagaaaactgtgcccagacctgccaatgtcaccatggtgggacctgccatccccaggatgggagctgtatctgccccctaggctggactggacaccactgcttagaaggctgccctctggggacatttggtgctaactgctcccagccatgccagtgtggtcctggagaaaagtgccacccagagactggggcctgtgtatgtcccccagggcacagtggtgcaccttgcaggattggaatccaggagccctttactgtgatgccgaccactccagtagcgtataactcgctgggtgcagtgattggcattgcagtgctggggtcccttgtggtagccctggtggcactgttcattggctatcggcactggcaaaaaggcaaggagcaccaccacctggctgtggcttacagcagcgggcgcctggacggctccgagtatgtcatgccagatgtccctccgagctacagtcactactactccaaccccagctaccacaccctgtcgcagtgctccccaaaccccccaccccctaacaaggttccaggcccgctctttgccagcctgcagaaccctgagcggccaggtggggcccaagggcatgataaccacaccaccctgcctgctgactggaagcaccgccgggagccccctccagggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaa

SEQ ID NO: 166399 - DNA, 642 bp, Homo sapiens
  Payload ID: 12762
  Gene Symbol: PEAR1
  Gene Name: platelet endothelial aggregation receptor 1
  ENST ID: ENST00000455314
  CDS Start-End: 123-642
ggctggggctcgaagtggggaccctcgccccgtcctcggctgtccagtcctcctcctcgcagaccccggcggttcctaccccaggccgcaggggagacggggccccaaggcaggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtggggtatgttcttgcccttctggtctgcagcccccgaact

SEQ ID NO: 166400 - DNA, 688 bp, Homo sapiens
  Payload ID: 12762
  Gene Symbol: PEAR1
  Gene Name: platelet endothelial aggregation receptor 1
  ENST ID: ENST00000444016
  CDS Start-End: 150-383
cccgcctccccgccgctcccgcagtcaggctggggctcgaagtggggaccctcgccccgtcctcggctgtccagtcctcctcctcgcagaccccggcggttcctaccccaggccgcaggggagacggggccccaaggcaggcctctgcaatgtcaccgcctctgtgtcccctccttctcctggctgtgggcctgcggctggctggaactctcaaccccagtgatcccaatacctgcagcttctgggaaagcttcactaccaccaccaaggagtcccactcccgccccttcagcctgctcccctcagagccctgcgagcggccctgggagggcccccatacttgcccccagcccacaaactcagaggaaactcctggcttctagggattcattctgcatggtctgtgtcggggttgtataccggaccgtgtaccgtcaggtggtgaagacggaccaccgccagcgcctgcagtgctgccatggcttctatgagagcagggggttctgtgtcccgctctgtgcccaggagtgtgtccatggccgttgtgtggcacccaatcagtgccaatgtgtgccaggctggcggggcgacgactgttccagtgagtgtgccccaggaatgtgggggccacagtgtgacaagccctgcagctgcggcaacaacagctcgtgtgatcccaagagtgggg

SEQ ID NO: 166401 - DNA, 604 bp, Homo sapiens
  Payload ID: 12763
  Gene Symbol: PF4
  Gene Name: platelet factor 4
  Uniprot ID: P02776
  ENST ID: ENST00000296029
  CDS Start-End: 172-477
atcttagtttccgcaccgcagttcctcggtgtccacttcaggcttccggactggaaggacagccgggaataaaacgtgccggcgaggctcaggagtcattggccacagagacccagcccgagtttcccatcgcactgagcactgagatcctgctggaagctctgccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaacttctgatatttgtgttatccttatgattttaaataaacaaaataaatcaa

SEQ ID NO: 166402 - DNA, 522 bp, Homo sapiens
  Payload ID: 12764
  Gene Symbol: PF4V1
  Gene Name: platelet factor 4 variant 1
  Uniprot ID: P10720
  ENST ID: ENST00000226524
  CDS Start-End: 175-489
tcttagctcctgcaccacagttcctcgctgtccaccccaggcttccggactggaaggacagtgggacagtgacgggggataaaagaagcctggtgaggccaggagtcactgcctgcagaaccccagcccgactttccctgcgcactgggatcctgctggaacctcagctgcaacatgagctccgcagccaggtcccgcctcacccgcgccacccgccaggagatgctgttcttggcgttgctgctcctgccagttgtggtcgccttcgccagagctgaagctgaagaagatggggacctgcagtgcctgtgtgtgaagaccacctcccaggtccgtcccaggcacatcaccagcctggaggtgatcaaggccggaccccactgccccactgcccaactcatagccacgctgaagaatgggaggaaaatttgcttggatctgcaagccctgctgtacaagaaaatcattaaggaacatttggagagttagctactagctgcctaagtgtgcactttcaatcta

SEQ ID NO: 166403 - DNA, 852 bp, Homo sapiens
  Payload ID: 12765
  Gene Symbol: PECAM1
  Gene Name: platelet/endothelial cell adhesion molecule 1
  ENST ID: ENST00000564866
  CDS Start-End: 162-852
gaggagagtggctgcccaaggtggggtttgtcttttgccgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgg

SEQ ID NO: 166404 - DNA, 579 bp, Homo sapiens
  Payload ID: 12765
  Gene Symbol: PECAM1
  Gene Name: platelet/endothelial cell adhesion molecule 1
  ENST ID: ENST00000563523
  CDS Start-End: 29-579
tactctgtttccacatcactttaactccatgagcatcgaagcttctggaatcaacatgtttcttatgtttcttgcaggttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgt

SEQ ID NO: 166405 - DNA, 580 bp, Homo sapiens
  Payload ID: 12765
  Gene Symbol: PECAM1
  Gene Name: platelet/endothelial cell adhesion molecule 1
  ENST ID: ENST00000569967
  CDS Start-End: 177-580
tttttctgtgcagttaacgagtcgctatgtttcggatctgcgttacttccccggtatttgaaggcaggagcactgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggt

SEQ ID NO: 166406 - DNA, 6831 bp, Homo sapiens
  Payload ID: 12765
  Gene Symbol: PECAM1
  Gene Name: platelet/endothelial cell adhesion molecule 1
  ENST ID: ENST00000563924
  CDS Start-End: 214-2430
ccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgcagatctgtgaaatgttgtcttctgaggggccacatgcatctatagtgctgaggactccttgggcctctgaagtcacagagagaaccgagcaggtctatgtttttgttttgttgttttgagacggagattcgctcttgttgcccgggctggactgcagcggcgcaacctctgctcactgcaacctccgcctcctgggttcaagcagttctcctgtctcagcctcccgagtagctgggattacaggcacatgtcaccacgcctggctaatttttgtatttttagtagagatggggtttcaccacgttggccaggctgatctcgaatgcctgacctttggtgatctgcccgccttgtcctcatgtgtgctccacaggcctttgggttgggattgcaggcgtgagccaccatgcccagcctagactcttttgacaatatgatgaaagctgttggttcctttccccaacacacacacaccgagttgtatcacgaaaatgtcatacaatttccaggttttctgagtggtgggctcagattgaggtcaaaggatcagacgacctctaacgaccttcatgtctctgttgatgatctggggacagccagatcccctgtgtccagggagttccttagtcccttgccaccaccagagaagggcaattgccacgggagctgcaaagaccctattcctactcctggtgccttacttatgcagcacgactgaattttttgttttgttttgttttgttgagacaggggcttgctctgttgcccaggctggagtgcagtggcacaacaatggctcaccgcagcctcgaacccctgggctcaagcgatcctcccatctcagcttcctgggtagctgggaccagaggcgtgagccgccatagctggctaatttttaattttttttttgcagagatgaggtttcaccatggtgcccaggctggtctcgaacttctgggctcaagtgatcctccctccttggcctcgcaaagtgctgggattgcaggcatgagccaccgcccccggcctgtggagcacacatgagtttaaaattactttcccttctgcctatatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcactgaaggacttaaaatggtccttagccaacacacagtaaaacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagtagagatgcagactaacagagagccaattacaaagcagtgtgacaagcgtcatggtggaaaattaaaagctcaaacaagggcacatgggaggggcttccaacacagactttgggggatccaggaaggtctaagaggaaagtgggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaagggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaa

SEQ ID NO: 166407 - DNA, 821 bp, Homo sapiens
  Payload ID: 12766
  Gene Symbol: PAFAH1B2
  Gene Name: platelet-activating factor acetylhydrolase 1b, catalytic subunit 2 (30kDa)
  ENST ID: ENST00000304808
  CDS Start-End: 1-528
gctgctgctggtgctggggccggaggagggacgcgccggagcgggaccgacgggaccgagcgagcgaccgacgcgccacccgccgacgcctcagccgcttggggcccgcacggaccctctacttcagtcattgttgtctgggtaggaacaaataaccacgaaaatacagcagaagaagtagcaggtgggatcgaggccattgtacaacttatcaacacaaggcagccacaggccaaaatcattgtattgggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttctt

SEQ ID NO: 166408 - DNA, 2517 bp, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENST ID: ENST00000419197
  CDS Start-End: 143-541
agtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggcgtgagtcaccgcaccaggccatcttcaggtcattttaacaatacccctgagccacctgaagcttcctccctgtcctctcaccccaaacttcataaatcccctgtgacttaaaatggagctggactcatgggtccagcaagctcctcagctgtgtgttgaatggtcccatttctttggtccattcaacactcaggctcaggaagggtggtccacagggaaatataagtcaaataagccttatggccccaccctgaccgcttgagggccacggttagggttgagctctttgtatattatgccagggaatgcggtagctggacctgtgcacaaggccaggatcacatccctgaggccccgacatctcccctgtgtgctcacaagtctggctttgagacacaccactgcctttttttgctgactgctgcagccaacaaaaaggcattctctcccagtggacagacctcagaaaggacctattcataagtgcggggtagggcagagggactgaggaaagttctgcagacctgggaacagcaagaaaatgtgcagttgctgccctcccactctgtagacgcagggtcctgacgattcaaaagttaagtcttgagaccttgcaaaagggaaggatcccttcagagtttgcttggatggatttctctccagatattgccagcggaaagggagcaaacagaaatagtgatagtccacagttgtttggttccagagcagtggttctcaaacttcattgtgcatagcaagcttctggagtgccccgttaaattgcagttttctgggctccacctcccaagatgaattaagtgtgaagtaggactctggatgtgcgtttaaaacaggcgtagggtcacatcttgccccaaagttatgaggccaacttagagtagtggtgcttgcctgtaatccagctactcgagaggctgtggcagatcgcttgaagccaggagttcaagaccagcctgggcaatgtatcacgagtgtttcttaatgtttcagattatttactggcaagatgagcaggattaccatgaaagaaaagtccagatggactgaggaaatcctacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagtttttctgagcgtcactttcctcatctgtataatgaggggttggccaaggaaacccataaggttatcttccagctgactttctaattggtgaaccctttggaaaaggggtgcagcttgcttctggtcttcatcctcaagtatgctgtgcttggacaggggccaaaactaattcctccactcaccatttgcccagcataactacaacagtacctggcacatcgtggatgcttattaaatatttattgcaggaatgagtaaatataactaactgatcataaggtaaaatagtcttcattggaacaaggctccagatagttgggcagggctgggagctgagactgctgcaatcctgccagctgagagaactctgacaaggcactgatctgggtggctttattaggatgtctgacagcttcagaggtggccacatttcttttcctttaaacatgtctaatttggccgggcgcagtggctcacgcctgtaatcccaacactttgggaagcctaggtgggtggatcactcgaggtcaggagttcgagatcagcctgaccaatatggtgaaaccccgctttactaaaaatacaagaaattagcagggtgtggtggcgggtgcctgtagtcccagctacttgggaggctgaggcaggagcatcgcctgaactcaggaggcggagattgcagtgagctgagatcacaccactgtactccagcatgggtgacagtgagactccatctc

SEQ ID NO: 166409 - DNA, 850 bp, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENST ID: ENST00000530272
  CDS Start-End: 83-691
gggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtaaagcagccgcctccaaatactctatctcagagatagtgagactagaacaagggtcggttaactggtcgatcgggacctatcctgatgacacaccagcaactaccaggccagcaatattacaattatttactggcaagatgagcaggattaccatgaaagaaaagtccagatggactgaggaaatcctacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagt

SEQ ID NO: 166410 - DNA, 1056 bp, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENST ID: ENST00000529887
  CDS Start-End: 129-596
tgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgattatttactggcaagatgagcaggattaccatgaaagaaaagtccagatggactgaggaaatcctacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagtttttctgagcgtcactttcctcatctgtataatgaggggttggccaaggaaacccataaggttatcttccagctgactttctaattggtgaaccctttggaaaaggggtgcagcttgcttctggtcttcatcctcaagtatgctgtgcttggacaggggccaaaactaattcctccactcaccatttgcccagcataactacaacagtacctggcacatcgtggatgcttattaaatatttattgcaggaatgagtaaatataactaactgatcataaggtaaaa

SEQ ID NO: 166411 - DNA, 4198 bp, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENST ID: ENST00000527958
  CDS Start-End: 160-849
gtggcaggggaaccggaagtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttcttgggacaacatcaagcctaaatactgaacaatatgaagattcttttcttggcctttctgtggattatgtcatatataataattatcagaatcattctacttggctttaaaacatgttttctccaatttttttaaggttcataatttagccttttgtttttatgttgcttagattcttatgtatactgaatattttattaacatgtagcatcaggttgaacatgcttgtcattgatatatggaagatgctatagttagaagtgaatttgttctgctttcttaatcttttccatgcttagcagtgaaaaacaggttttgccccagtagagggattctttggagggtattattttttatgctgctgaatatcatgtctataatagacccgtgcatgcagcctttcctccttattccccttcatgcccccctttccccttcattccccccgccaccccgtttttttttttttttttttttttttggttcttgttgacattacaagcttttaacacatttttgacctaggagccctgttgctggaagtatagtctccagccagttactctcatgatagtactgctataaaactcattcttgtgtggtgttctgtgctatagattctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccgtgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaattt

SEQ ID NO: 166412 - DNA, 1003 bp, Homo sapiens
  Payload ID: 12767
  Gene Symbol: PAFAH1B3
  Gene Name: platelet-activating factor acetylhydrolase 1b, catalytic subunit 3 (29kDa)
  Uniprot ID: Q15102
  ENST ID: ENST00000262890
  CDS Start-End: 263-958
cgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtg

SEQ ID NO: 166413 - DNA, 1098 bp, Homo sapiens
  Payload ID: 12767
  Gene Symbol: PAFAH1B3
  Gene Name: platelet-activating factor acetylhydrolase 1b, catalytic subunit 3 (29kDa)
  Uniprot ID: Q15102
  ENST ID: ENST00000538771
  CDS Start-End: 358-1053
tcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtg

SEQ ID NO: 166414 - DNA, 380 bp, Homo sapiens
  Payload ID: 12767
  Gene Symbol: PAFAH1B3
  Gene Name: platelet-activating factor acetylhydrolase 1b, catalytic subunit 3 (29kDa)
  ENST ID: ENST00000599778
  CDS Start-End: 96-380
gaacatgaccaggacgtttagcagggagtgagccccccacctggtcccagagaagagggagatctgagaagacactgaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaag

SEQ ID NO: 166415 - DNA, 465 bp, Homo sapiens
  Payload ID: 12767
  Gene Symbol: PAFAH1B3
  Gene Name: platelet-activating factor acetylhydrolase 1b, catalytic subunit 3 (29kDa)
  ENST ID: ENST00000596265
  CDS Start-End: 47-465
gattttccccgcccactctcgactcttcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactgggcctgcttccgcgaggccaacatcccaacccacttcgggagaagaaccg

SEQ ID NO: 166416 - DNA, 649 bp, Homo sapiens
  Payload ID: 12767
  Gene Symbol: PAFAH1B3
  Gene Name: platelet-activating factor acetylhydrolase 1b, catalytic subunit 3 (29kDa)
  ENST ID: ENST00000594989
  CDS Start-End: 1-607
cccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctca

SEQ ID NO: 166417 - DNA, 646 bp, Homo sapiens
  Payload ID: 12767
  Gene Symbol: PAFAH1B3
  Gene Name: platelet-activating factor acetylhydrolase 1b, catalytic subunit 3 (29kDa)
  ENST ID: ENST00000601865
  CDS Start-End: 358-646
tcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattg

SEQ ID NO: 166418 - DNA, 582 bp, Homo sapiens
  Payload ID: 12767
  Gene Symbol: PAFAH1B3
  Gene Name: platelet-activating factor acetylhydrolase 1b, catalytic subunit 3 (29kDa)
  ENST ID: ENST00000595530
  CDS Start-End: 89-582
gtacagcaaatggtttcttcccatttgctagacagagggctagattttccccgcccactctcgactcttcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctgg

SEQ ID NO: 166419 - DNA, 5497 bp, Homo sapiens
  Payload ID: 12768
  Gene Symbol: PAFAH1B1
  Gene Name: platelet-activating factor acetylhydrolase 1b, regulatory subunit 1 (45kDa)
  Uniprot ID: P43034
  ENST ID: ENST00000397195
  CDS Start-End: 452-1684
gcgagaaggagaaggaggggagcgctcgggcgcgagcgagagaaaccgcgagcgccgagcttggactcgagccccggaacggctgaggagcccgcccgctcccctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtggataagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctataaaacta

SEQ ID NO: 166420 - DNA, 661 bp, Homo sapiens
  Payload ID: 12768
  Gene Symbol: PAFAH1B1
  Gene Name: platelet-activating factor acetylhydrolase 1b, regulatory subunit 1 (45kDa)
  ENST ID: ENST00000570400
  CDS Start-End: 364-408
tgaaggacggaagaggccctgcggaggcggcggtgcagcgctccgagacagagtttctctctggcgcccagcctggagtatagtgccacaatcatggttcactgcagccttgacctcctgggctcaagcaaccctcctgcctctgccgcctgagtagctgggactgactataggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcaga

SEQ ID NO: 166421 - DNA, 1021 bp, Homo sapiens
  Payload ID: 12768
  Gene Symbol: PAFAH1B1
  Gene Name: platelet-activating factor acetylhydrolase 1b, regulatory subunit 1 (45kDa)
  ENST ID: ENST00000574468
  CDS Start-End: 1-627
tctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaa

SEQ ID NO: 166422 - DNA, 557 bp, Homo sapiens
  Payload ID: 12768
  Gene Symbol: PAFAH1B1
  Gene Name: platelet-activating factor acetylhydrolase 1b, regulatory subunit 1 (45kDa)
  ENST ID: ENST00000576586
  CDS Start-End: 312-557
aggcagaaaggggcggtaggtggccgggccccgctgcctctcgcgcctcccggggcccgccacacacggtgccaacgggacgccgcggtcggccgcatgagcgcaaaagcagggcagcgaggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggt

SEQ ID NO: 166423 - DNA, 3581 bp, Homo sapiens
  Payload ID: 12769
  Gene Symbol: PAFAH2
  Gene Name: platelet-activating factor acetylhydrolase 2, 40kDa
  Uniprot ID: Q99487
  ENST ID: ENST00000374282
  CDS Start-End: 181-1359
cgagaagtgcttccaagcgtccattttgagccttggaaactacgacgaccaaagggccacgggttcatgggtcgtttctcatttccgtcgagttaaacgtctggggctgcttctgaggaatcagcttgactggccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtcttaaaaaaaaaaaaaagaaaaagaaaaatttaaaataaataaaatttaaaaacgcagaaggccactcccagagaggcctaggagtaccttggtcattttttcttgcctcaaatattataaacctccaacttgctcagaatcagggtgcttttattgtctgttttctggctctgaggcccttgccccaaatttaagtcagatacagactgaatttccattctgttctgtttataatatgaatgatattaatactcttgtttgcttaatgttatgttggaattttctgtttaatctgcagtagagcaagatggagagccatctggaattgacttccttctgtctttcttctgtgttcgcttactacttgggcccatgtgggaaaaaaactttaaaaggaaggaagtcttcttagggatccagttcaaagctatttgggggcatcaaactgaaactctcttctccactactcaagacttcgtgcctcagtccaagtaggtaagagcaaaagggaaatgcatctctacacaatggcccatggtcagggccaccagagcaagctgggcctagatctccacctgtcagtgactggccattctaagaggtgaaacagcagatcgttgaggctgtgagggaggatctttgaattcccatgagacatagcataagaagggtatcattaaagccctgggctctaaagttacagagcctggttttgagtcctggctccaccactgccaactgggtaaatttgagcaaatggtattctctttcttatctcagctcctgcgtttctaaaatgagggtctgcgttatgaatagttaggaggattaagtgagaggatgtataacccatgggttacttaaaagtatatttcctaccttccaaacatgagatttttctagttatagtttcttttctagcttgattgctttgtggtcagagaaaatgacccatatggtttccatccttcaaaatttgttgaaacttggttgttggcctagtatgagatcaatgttgtaaatgtgccatgtatgtttaaaaagactatatattctgaa

SEQ ID NO: 166424 - DNA, 2523 bp, Homo sapiens
  Payload ID: 12769
  Gene Symbol: PAFAH2
  Gene Name: platelet-activating factor acetylhydrolase 2, 40kDa
  Uniprot ID: Q99487
  ENST ID: ENST00000374284
  CDS Start-End: 126-1304
tgaggaatcagcttgactggcaacaggaagccgagaggaaaccagcaagcggctgctgttctgtgttcccccatccagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatggatccctttccgtcgagttgaggaaggggagaaggaatttcatgttcggaatccccaggtgcatcagcgggtaagcgagtgtttacgggtgttgaagatcctgcaagaggtcactgctgggcagactgtcttcaacatcttgcctggtggcttggatctgatgactttgaagggcaacattgacatgagccgtgtggctgtgatgggacattcatttggaggggccacagctattctggctttggccaaggagacccaatttcggtgtgcggtggctctggatgcttggatgtttcctctggaacgtgacttttaccccaaggcccgaggacctgtgttctttatcaatactgagaaattccagacaatggagagtgtcaatttgatgaagaagatatgtgcccagcatgaacagtctaggatcataaccgttcttggttctgttcatcggagtcaaactgactttgcttttgtgactggcaacttgattggtaaattcttctccactgaaacccgtgggagcctggacccctatgaagggcaggaggttatggtacgggccatgttggccttcctgcagaagcacctcgacctgaaagaagactataatcaatggaacaaccttattgaaggcattggaccgtcgctcaccccaggggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatggctctcacagcacagggagaaaaactgaggtacacagaggtacctcagaagctctggatgtctttgggggttttgctaagtgtatcttgataggaaacaacaaaagcaggttgagatggggaagatgacagaacaacagtgttaaatggccatttgcacaggcctttgccacaacagagaagtagtttggtcagctaaaactcagctgcagcctggacagtagagcgagaccccatcttaaaaataaagaaggctgggcgtggtggctcatgcctgtaatcccaacactttgggaggccaaggcaggcagatcacttaaggccaggagttcaagaccacctggccaacatggtgaaaccccgtctctactaaaaatacaaaaaattagcctggcgtaatggcaggcgcctataatcccagctactcaggaggctgaagcagaagaatcacttgaacctaggaggcggaggttgcagtgagtcaagatcgcgccactgcactccagcctgggtgacagagcaagactctgtcttaaaaaaaaaaaaaagaaaaagaaaaatttaaaataaataaaatttaaaaacgca

SEQ ID NO: 166425 - DNA, 778 bp, Homo sapiens
  Payload ID: 12769
  Gene Symbol: PAFAH2
  Gene Name: platelet-activating factor acetylhydrolase 2, 40kDa
  ENST ID: ENST00000439092
  CDS Start-End: 222-778
aagggtccccattccttctttccgatccgcgattaccctggactcgaagtcagcagacccggttctaggccagctctgcctctcaccctctgtgaccttgggcaaatcatacaactctgggactcagtttcttcctctctaaaacggagatgactgttgctccatcagtctcagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagatgtgtgtatttcagggaccggtcagcggcaaccacctatttctgcaagcaggccccagaagagaaccagcccaccaatgaatcgctgcaggaggaatggatccctttccgtcgagttgaggaaggggagaaggaatttcatgttcg

SEQ ID NO: 166426 - DNA, 748 bp, Homo sapiens
  Payload ID: 12769
  Gene Symbol: PAFAH2
  Gene Name: platelet-activating factor acetylhydrolase 2, 40kDa
  ENST ID: ENST00000441420
  CDS Start-End: 253-748
ggggctgcttctgaggaatcagcttgactggaagggtccccattccttctttccgatccgcgattaccctggactcgaagtcagcagacccggttctaggccagctctgcctctcaccctctgtgaccttgggcaaatcatacaactctgggactcagtttcttcctctctaaaacggagatgactgttgctccatcagtctcagccagcaagttcagctccggcaagtcatttgattcacccggtgatgaaatgggggtcaaccagtctgtgggctttccacctgtcacaggaccccacctcgtaggctgtggggatgtgatggagggtcagaatctccaggggagcttctttcgactcttctacccctgccaaaaggcagaggagaccatggagcagcccctgtggattccccgctatgagtactgcactggcctggccgagtacctgcagtttaataagcgctgcgggggcttgctgttcaacctggcggtgggatcttgtcgcctgcctgttagctggaatggcccctttaagacaaaggactctggataccccttgatcatcttctcccatggcctaggagccttcaggactttgtattcagccttctgcatggagctggcctcacgtggctttgtggttgctgtgccagagcacagggaccggtcagcggcaaccacctatttctgcaagcaggccccagaagagaaccagcccaccaatgaatcgctgcaggaggaatgga

SEQ ID NO: 166427 - DNA, 1539 bp, Homo sapiens
  Payload ID: 12770
  Gene Symbol: PTAFR
  Gene Name: platelet-activating factor receptor
  Uniprot ID: P25105
  ENST ID: ENST00000305392
  CDS Start-End: 191-1219
cctcctgtgcactcattacctgcttcctgagctccccgagaagtcatccaggacctccccgagaagccgtccaggaaacatgctctcaggggacccccatctgcctcagcctctttgtcactgcctggaccattgtccctgctgtttctcaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaacca

SEQ ID NO: 166428 - DNA, 4491 bp, Homo sapiens
  Payload ID: 12770
  Gene Symbol: PTAFR
  Gene Name: platelet-activating factor receptor
  Uniprot ID: P25105
  ENST ID: ENST00000373857
  CDS Start-End: 636-1664
ggcacatgctcgctgtctgtgtcttgtcatctcgtcttttgtcttggatcttaccttgtctttgtccctgaatctccttgttcctctcatctctcccggtgtttacatctgtctttttccctgagcctcgctccctccatccattcctccgccctctcattttttttcccgactccctcctgcctcctccctttctcctttgattttcctggtccctcatctctcctccctcctctttctcactctcatgctccctttttcgctctcttgagtacatgcacttgctttctctctcttgcttttcctctttctcaccttagctcctggcctcgggcgctgtctacaccccaccccatccctcgctctttgagaagcctctgtgcagtgcccaggtcctggcggcccagcttggaagttcctgtggtaccccttgagaggccctagggccacagcatttcctcccaggggtgacttggtagtgatacgctctgtttcttcacttctgcaattgccagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccatctcaaaaaaaaaaaaaaaaaaaaaaaaaaagctttgggcaactactctcaagtgatagaggtagactgggttaggaaaggacactgccctcactgtatggcactaccttggggcagacttttgagctaagatgttgccatcctctctccaccctccggcacaaggtctttgtgacctttctcaggggaaggggcttgatggaaccttctctgactcatctggcaacctgtccctaatggtgaccaaagaagataaaacatgaacagaccaaaagctaggacaagagcttgcttcccaagacagacgtgtctgtctgcaaaggccttgcctctagtccagtcagctctgggggagtgggaaggagatgcccacctcctctttctgtctcaacaatagtccctaattaagtaccttctgtggggcagccacccactgagggtgggcaaaggccccttgaaagcaaaattggggctgggctcagtggctcatgcctataatcccagcactttgggaggccaaggcaggcagatcacctgaggtccggagttcgagaccagcctggccaacgtggtgaaacgccatctccactaagaatacaaaaatatggctcatgcctgtaatcccagtactttgggaggctgaggtgggccgatcatttgaagttaggagtttgagaccagcctgaccaatatggtaaaaccccgtctctactaaaaatacaaaaaaattagcctggcgtggtggcgcatgcctgtagtcccataggctgtagctactgggaggaggcggagcttgcagtgagccgagatcacgccactgctctccagcctgggcgacagagtgagactctgtgtcaaaaacaaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaa

SEQ ID NO: 166429 - DNA, 4191 bp, Homo sapiens
  Payload ID: 12770
  Gene Symbol: PTAFR
  Gene Name: platelet-activating factor receptor
  Uniprot ID: P25105
  ENST ID: ENST00000539896
  CDS Start-End: 336-1364
gctgctgctcattggagggtagagcagagtgagtcacacacctgtgcctgggcccgtcctctgcctcctgtgcactcattacctgcttcctgagctccccgagaagtcatccaggacctccccgagaagccgtccaggaaacatgctctcaggggacccccatctgcctcagcctctttgtcactgcctggaccattgtccctgctgtttctcagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccatctcaaaaaaaaaaaaaaaaaaaaaaaaaaagctttgggcaactactctcaagtgatagaggtagactgggttaggaaaggacactgccctcactgtatggcactaccttggggcagacttttgagctaagatgttgccatcctctctccaccctccggcacaaggtctttgtgacctttctcaggggaaggggcttgatggaaccttctctgactcatctggcaacctgtccctaatggtgaccaaagaagataaaacatgaacagaccaaaagctaggacaagagcttgcttcccaagacagacgtgtctgtctgcaaaggccttgcctctagtccagtcagctctgggggagtgggaaggagatgcccacctcctctttctgtctcaacaatagtccctaattaagtaccttctgtggggcagccacccactgagggtgggcaaaggccccttgaaagcaaaattggggctgggctcagtggctcatgcctataatcccagcactttgggaggccaaggcaggcagatcacctgaggtccggagttcgagaccagcctggccaacgtggtgaaacgccatctccactaagaatacaaaaatatggctcatgcctgtaatcccagtactttgggaggctgaggtgggccgatcatttgaagttaggagtttgagaccagcctgaccaatatggtaaaaccccgtctctactaaaaatacaaaaaaattagcctggcgtggtggcgcatgcctgtagtcccataggctgtagctactgggaggaggcggagcttgcagtgagccgagatcacgccactgctctccagcctgggcgacagagtgagactctgtgtcaaaaacaaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaa

SEQ ID NO: 166430 - DNA, 1308 bp, Homo sapiens
  Payload ID: 12771
  Gene Symbol: PDGFA
  Gene Name: platelet-derived growth factor alpha polypeptide
  Uniprot ID: P04085
  ENST ID: ENST00000354513
  CDS Start-End: 394-1029
tccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccgcgctgcgggcgcgcactccctgtttctcctcctcctggctggcgctgcctgcctctccgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaaagcagccaaccagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaa

SEQ ID NO: 166431 - DNA, 689 bp, Homo sapiens
  Payload ID: 12771
  Gene Symbol: PDGFA
  Gene Name: platelet-derived growth factor alpha polypeptide
  ENST ID: ENST00000400761
  CDS Start-End: 1-618
cagcgccaagctgcagccctcggttcccagtccccaagcccggcggggctcagggccggcgcagtcccgcccgcccgggcctgcttacaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacggatgtgaggtgaggatgagccgcagccctttcctgggacatggatgtacatggcgtgttacattcctgaacctactatgtacg

SEQ ID NO: 166432 - DNA, 2305 bp, Homo sapiens
  Payload ID: 12771
  Gene Symbol: PDGFA
  Gene Name: platelet-derived growth factor alpha polypeptide
  Uniprot ID: P04085
  ENST ID: ENST00000402802
  CDS Start-End: 409-999
ttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccgcgctgcgggcgcgcactccctgtttctcctcctcctggctggcgctgcctgcctctccgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacggatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgtttttttttttttttttttacaccataaagtgattattaagctttcctttttactctttggctagctttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttgatccaaaattaaaaaaaaaaataccaccaacaaaa

SEQ ID NO: 166433 - DNA, 663 bp, Homo sapiens
  Payload ID: 12771
  Gene Symbol: PDGFA
  Gene Name: platelet-derived growth factor alpha polypeptide
  ENST ID: ENST00000405692
  CDS Start-End: 405-663
cggccggagcgccggggcgggggcggggaccggctctctggccctttttggcgcagcagctctgggcgctgcccgctgccgccgctggggcccgagagaggcgagccggcgacggcggcgcttctgcggcggcctcctccctccccacccggtgccgcaggattgcagctggcactggagggtgggcaagctcgagggaggggcgcggagccccggcgcggagccgggcgcggggctttgatggatttagctgcttgcgcgagcgcgtgtgtgctccctgccgcggcggcggcgcccgggccctgccgggtccgcacgaaccccgagcgcttccgaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaa

SEQ ID NO: 166434 - DNA, 3497 bp, Homo sapiens
  Payload ID: 12772
  Gene Symbol: PDGFB
  Gene Name: platelet-derived growth factor beta polypeptide
  Uniprot ID: P01127
  ENST ID: ENST00000331163
  CDS Start-End: 789-1514
gcagctcgcagctcgcagcccgcagcccgcagaggacgcccagagcggcgagcgggcgggcagacggaccgacggactcgcgccgcgtccacctgtcggccgggcccagccgagcgcgcagcgggcacgccgcgcgcgcggagcagccgtgcccgccgcccgggccccgcgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctcactcgggctcgggatccgcccaggtagcggcctcggacccaggtcctgcgcccaggtcctcccctgccccccagcgacggagccggggccgggggcggcggcgcccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaatgaatccgccggaggtctgtctgttggcatcgtgcgtgacaattaacctttctgccttggcaggatgtgccgacagcttgcggcgtgttcctctcactctgggagcctcaggcgtgatctcacacactggcgtgcacatacacacacacacacatacatgctcacacatgcgtgcacatacacgcaggcctgcaacttgggggaggcctctgtctggcgggaagaagagacacacaggctactctgttggtcttggtcctggcacagctcctgacacgtggacttgtgcgtgtctctggcagtgacgagagatgggtttctgcag

SEQ ID NO: 166435 - DNA, 1125 bp, Homo sapiens
  Payload ID: 12772
  Gene Symbol: PDGFB
  Gene Name: platelet-derived growth factor beta polypeptide
  Uniprot ID: P01127
  ENST ID: ENST00000381551
  CDS Start-End: 38-718
agagagagagagagactgactgagcaggaatggtgagatgtttatcatgggcctcggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagca

SEQ ID NO: 166436 - DNA, 554 bp, Homo sapiens
  Payload ID: 12772
  Gene Symbol: PDGFB
  Gene Name: platelet-derived growth factor beta polypeptide
  ENST ID: ENST00000455790
  CDS Start-End: 122-554
aaaaacatctgagggagcgctggggtcggagccgtccccacccctcccagcctcacgtagccgtgagttggcaagtctacccggaatccagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacc

SEQ ID NO: 166437 - DNA, 556 bp, Homo sapiens
  Payload ID: 12772
  Gene Symbol: PDGFB
  Gene Name: platelet-derived growth factor beta polypeptide
  ENST ID: ENST00000440375
  CDS Start-End: 149-556
acacttcttccgggaaagagtgaagggccccactgccctttgccatccagcttcctctggctttgctaatggccctagggggcaggagaccaactgctggaatcccagagccctggagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaag

SEQ ID NO: 166438 - DNA, 6576 bp, Homo sapiens
  Payload ID: 12773
  Gene Symbol: PDGFRA
  Gene Name: platelet-derived growth factor receptor, alpha polypeptide
  Uniprot ID: P16234
  ENST ID: ENST00000257290
  CDS Start-End: 332-3601
aagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccagatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaactggcggattcgaggggttccttccacttctggggccacctctggatcccgttcagaaaaccactttattgcaatgcagaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggcattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttata

SEQ ID NO: 166439 - DNA, 2991 bp, Homo sapiens
  Payload ID: 12773
  Gene Symbol: PDGFRA
  Gene Name: platelet-derived growth factor receptor, alpha polypeptide
  Uniprot ID: P16234
  ENST ID: ENST00000509490
  CDS Start-End: 118-2349
gggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccagatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaacta

SEQ ID NO: 166440 - DNA, 573 bp, Homo sapiens
  Payload ID: 12773
  Gene Symbol: PDGFRA
  Gene Name: platelet-derived growth factor receptor, alpha polypeptide
  ENST ID: ENST00000512522
  CDS Start-End: 111-573
gaggttggagccaagatggctgaataggaacagctccggtctacagctcccagcatcagcgatgcagaagatgggtgatttctgcatttccatctgagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatc

SEQ ID NO: 166441 - DNA, 580 bp, Homo sapiens
  Payload ID: 12773
  Gene Symbol: PDGFRA
  Gene Name: platelet-derived growth factor receptor, alpha polypeptide
  ENST ID: ENST00000512143
  CDS Start-End: 139-580
attactgttggagctacagggagagaaacagaggaggagactgcaagagatcattggaggccgtgggcacgctctttactccatgtgtgggacattcattgcggaataacatcggaggagaagagacggggttttgccatgctgcctagactggtcttgaactcctgggctcaaatgatctgcctgcctcagcttcccaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccag

SEQ ID NO: 166442 - DNA, 2202 bp, Homo sapiens
  Payload ID: 12773
  Gene Symbol: PDGFRA
  Gene Name: platelet-derived growth factor receptor, alpha polypeptide
  Uniprot ID: P16234
  ENST ID: ENST00000508170
  CDS Start-End: 149-805
ggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaa

SEQ ID NO: 166443 - DNA, 586 bp, Homo sapiens
  Payload ID: 12773
  Gene Symbol: PDGFRA
  Gene Name: platelet-derived growth factor receptor, alpha polypeptide
  ENST ID: ENST00000503856
  CDS Start-End: 110-586
gacaggttttaaatgagtgttttcattcctcgcctgcggtttggcgggacagcgctgcagcccatggtgtggagcgcggctgggggaccagggggagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgta

SEQ ID NO: 166444 - DNA, 771 bp, Homo sapiens
  Payload ID: 12773
  Gene Symbol: PDGFRA
  Gene Name: platelet-derived growth factor receptor, alpha polypeptide
  ENST ID: ENST00000504461
  CDS Start-End: 298-771
catttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcct

SEQ ID NO: 166445 - DNA, 5717 bp, Homo sapiens
  Payload ID: 12774
  Gene Symbol: PDGFRB
  Gene Name: platelet-derived growth factor receptor, beta polypeptide
  Uniprot ID: P09619
  ENST ID: ENST00000261799
  CDS Start-End: 471-3791
gctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaaatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttgagtttttctatctgtgtacttttttttaagggaaagattttaatattaaacctggtgcttctcactcacaga

SEQ ID NO: 166446 - DNA, 822 bp, Homo sapiens
  Payload ID: 12774
  Gene Symbol: PDGFRB
  Gene Name: platelet-derived growth factor receptor, beta polypeptide
  ENST ID: ENST00000517488
  CDS Start-End: 384-822
cgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagg

SEQ ID NO: 166447 - DNA, 3860 bp, Homo sapiens
  Payload ID: 12774
  Gene Symbol: PDGFRB
  Gene Name: platelet-derived growth factor receptor, beta polypeptide
  ENST ID: ENST00000520579
  CDS Start-End: 470-1189
ctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagggtgagccccctttctggcctgatgctcagcagagtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccc

SEQ ID NO: 166448 - DNA, 568 bp, Homo sapiens
  Payload ID: 12774
  Gene Symbol: PDGFRB
  Gene Name: platelet-derived growth factor receptor, beta polypeptide
  ENST ID: ENST00000517957
  CDS Start-End: 45-568
attggaactgtcacccggaggacaggctgtcagagctggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatca

SEQ ID NO: 166449 - DNA, 1901 bp, Homo sapiens
  Payload ID: 12775
  Gene Symbol: PDGFRL
  Gene Name: platelet-derived growth factor receptor-like
  Uniprot ID: Q15198
  ENST ID: ENST00000251630
  CDS Start-End: 442-1569
acttctgccttgttatcagaggagcgaggatgtggcctgtgtgccgcctaatcatgcctagaactgtctgcacctgctgatcttttgcttctgcgaactggctgcacctgctgttctcctgctcataccctagcccgtgcttaccctaattccctgttctcctgcctcaccaccagaggcccgggttgtctgcacagtctcattttccacgttattcctgtaatgaacccgtcctcccacccccaccagcagttacagggctgggtgcggagaccaactctggccagacacagaggagcagcaagaacccggggcaacggtcctaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctatgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgtt

SEQ ID NO: 166450 - DNA, 1905 bp, Homo sapiens
  Payload ID: 12775
  Gene Symbol: PDGFRL
  Gene Name: platelet-derived growth factor receptor-like
  Uniprot ID: Q15198
  ENST ID: ENST00000541323
  CDS Start-End: 446-1573
acttctgccttgttatcagaggagcgaggatgtggcctgtgtgccgcctaatcatgcctagaactgtctgcacctgctgatcttttgcttctgcgaactggctgcacctgctgttctcctgctcataccctagcccgtgcttaccctaattccctgttctcctgcctcaccaccagaggcccgggttgtctgcacagtctcattttccacgttattcctgtaatgaacccgtcctcccacccccaccagcagttacagggctgggtgcggagaccaactctggccagacacagaggagcagcaagaacccggggcaacggtcctgtgaaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctatgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgtt

SEQ ID NO: 166451 - DNA, 2869 bp, Homo sapiens
  Payload ID: 12776
  Gene Symbol: PLEK
  Gene Name: pleckstrin
  Uniprot ID: P08567
  ENST ID: ENST00000234313
  CDS Start-End: 180-1232
tgatcttccaacccagtgaggggaagaggatgtgatcatgcgaccgccagcagaagggaaattgtgaaagcgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaagaaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcagagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccaggcctcagggcctcttctggaaaatgaagaaattcaactagtagattcctgaggtccccctagcttaaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacctggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaagcagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaatgca

SEQ ID NO: 166452 - DNA, 1549 bp, Homo sapiens
  Payload ID: 12777
  Gene Symbol: PLEK2
  Gene Name: pleckstrin 2
  Uniprot ID: Q9NYT0
  ENST ID: ENST00000216446
  CDS Start-End: 142-1203
gcgccagggaggcgtcgccctgccgcgtcggagctgcttcctgggcgccgtgggcgcggactgcgcgggctgcgcgggtgccgaggagcgcgaggcgcggggaaggcgcacctggggtggccctggcgtgcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatgag

SEQ ID NO: 166453 - DNA, 695 bp, Homo sapiens
  Payload ID: 12777
  Gene Symbol: PLEK2
  Gene Name: pleckstrin 2
  ENST ID: ENST00000556532
  CDS Start-End: 1-353
tggccgagcagttcctggatgactccacagccctgtacacttttgctgagagctacaaaaagaagataagccccaaggaagaaattagcctgagcactgtggagttaagtggcacggtggtgaaacaaggctacctggccaagcaggaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttctta

SEQ ID NO: 166454 - DNA, 612 bp, Homo sapiens
  Payload ID: 12777
  Gene Symbol: PLEK2
  Gene Name: pleckstrin 2
  ENST ID: ENST00000554395
  CDS Start-End: 1-612
aaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctg

SEQ ID NO: 166455 - DNA, 736 bp, Homo sapiens
  Payload ID: 12777
  Gene Symbol: PLEK2
  Gene Name: pleckstrin 2
  ENST ID: ENST00000553387
  CDS Start-End: 13-246
gcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgtcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtct

SEQ ID NO: 166456 - DNA, 578 bp, Homo sapiens
  Payload ID: 12777
  Gene Symbol: PLEK2
  Gene Name: pleckstrin 2
  ENST ID: ENST00000555803
  CDS Start-End: 1-384
attgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcaggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggtaaggggttaaagggaatgtccagggaaacctcttcaaagtgattactaaggatgacacacactattacattc

SEQ ID NO: 166457 - DNA, 4183 bp, Homo sapiens
  Payload ID: 12778
  Gene Symbol: PSD
  Gene Name: pleckstrin and Sec7 domain containing
  Uniprot ID: A5PKW4
  ENST ID: ENST00000020673
  CDS Start-End: 528-3602
atgtaacaggtcatgtggcagcctcctagggacacgcgtggggtctggagcgggacacgcgtgtgcagccgggccttacgtgtggctcaaggggcggtgggcgagagagacgtggacacaagtggggtggggcacgtgagggtctggggaatagaaccaggggttccatgcgccctcctccttgtctggggcgggtcttaggttggcgggagagcccagcggggacctagcgacaaggggggctggcagcctccggggctctgggccctgggagagggcggggggtgggggggattagcgttgcctgagcggcgcgtagggggtagggggagggactgagaggcgggcgggcctggagcaaacgggagccgcgctgccttcacagctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgc

SEQ ID NO: 166458 - DNA, 3861 bp, Homo sapiens
  Payload ID: 12778
  Gene Symbol: PSD
  Gene Name: pleckstrin and Sec7 domain containing
  Uniprot ID: A5PKW4
  ENST ID: ENST00000406432
  CDS Start-End: 204-3278
cgcaaggcagcgagaagggagaagctagcagcggggagagacaagaaaggggtcaagttagctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgctg

SEQ ID NO: 166459 - DNA, 3382 bp, Homo sapiens
  Payload ID: 12778
  Gene Symbol: PSD
  Gene Name: pleckstrin and Sec7 domain containing
  Uniprot ID: A5PKW4
  ENST ID: ENST00000611678
  CDS Start-End: 862-2799
gcctgcgcagtgcgacaaatctggcgctgtccccttcagcaccacgcggagtccgcgccgcccctccccgcgctcagctgggcccagcctctcctctgtctctcctcggtctcagctctgggcgagcagcggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgctg

SEQ ID NO: 166460 - DNA, 4513 bp, Homo sapiens
  Payload ID: 12779
  Gene Symbol: PSD2
  Gene Name: pleckstrin and Sec7 domain containing 2
  Uniprot ID: Q9BQI7
  ENST ID: ENST00000274710
  CDS Start-End: 206-2521
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttctaa

SEQ ID NO: 166461 - DNA, 6665 bp, Homo sapiens
  Payload ID: 12780
  Gene Symbol: PSD3
  Gene Name: pleckstrin and Sec7 domain containing 3
  Uniprot ID: Q9NYI0
  ENST ID: ENST00000286485
  CDS Start-End: 91-1632
aggctcggcagtcactgaacttgggagctgaagaatactggacggggcttcggagaggaaggatggtccaggcgcaccccaggggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacag

SEQ ID NO: 166462 - DNA, 11689 bp, Homo sapiens
  Payload ID: 12780
  Gene Symbol: PSD3
  Gene Name: pleckstrin and Sec7 domain containing 3
  Uniprot ID: Q9NYI0
  ENST ID: ENST00000327040
  CDS Start-End: 104-3247
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatcatt

SEQ ID NO: 166463 - DNA, 6330 bp, Homo sapiens
  Payload ID: 12780
  Gene Symbol: PSD3
  Gene Name: pleckstrin and Sec7 domain containing 3
  ENST ID: ENST00000428502
  CDS Start-End: 168-1298
gaagatgctgggggaggcagcctggtgcttcttaagctaacgcggatcacggcgctcaggagctgctcaggcacaaccccgcagagttcctccagcgtgagagccttggaacggttggaaagtgcctttttatttctctaaaccccttccttagttgaccttcgaaaatgattggcgtgaatagtgtccagagtgccagcaaggtacgggtgaggacctcaggttccgtgaaatactcccgggaggattctatccggcggcagtctcacaggtcaaagtccatgaaaatttccaactcctcagagttttctgctaaggagaacaaggctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaataca

SEQ ID NO: 166464 - DNA, 11690 bp, Homo sapiens
  Payload ID: 12780
  Gene Symbol: PSD3
  Gene Name: pleckstrin and Sec7 domain containing 3
  Uniprot ID: Q9NYI0
  ENST ID: ENST00000440756
  CDS Start-End: 104-3250
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacgtaaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 166465 - DNA, 447 bp, Homo sapiens
  Payload ID: 12780
  Gene Symbol: PSD3
  Gene Name: pleckstrin and Sec7 domain containing 3
  ENST ID: ENST00000521027
  CDS Start-End: 1-358
gctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcagagtctcgctctgtcacccaggctggagtgcagtagcaccatcttggctcactgcaacctccacctcccaggttcaagcagttctcctgaatcagcctcccgaataactgggactacaggaaaatgaatctacattgtcaagtgagggtcatctggattcatctcaaataaacagtgctcttagtgactccgagta

SEQ ID NO: 166466 - DNA, 627 bp, Homo sapiens
  Payload ID: 12780
  Gene Symbol: PSD3
  Gene Name: pleckstrin and Sec7 domain containing 3
  ENST ID: ENST00000521475
  CDS Start-End: 202-627
cctgagacggaggaatcagctgctttcacttgctctgctccaaaggaaaagaaggaagggaggaaaaaatcccaggatccggacgtaagcaggggtggtgattgcagatccccacatcacaggcattgccaggcccctgcctccaagacactgggctggctacagcccctggcatggaggcttcctagcccagctcccatcatgagtgatgaaagcagcagtccctccatgggctggaagcactggccagtcacttctgccacccaggatctgtggggcatggacccccgatgcagggatgccttgggatgctcccctccaagggctgtcctggtccacgctgcagatggagcggaaaggactgtgctgaggagaggcgccgagacctgccaaatactccccaggagctgtaaggaggccacaggtaccacagcgcaggcgacaagggcatggctctacaggtactgtccagctgtgcacaccagcaagggctgcccagccccgcctgccactctgcctctcaaggcagagacatttgtttgggtgaacaatgcatctgcacattcccagagtgttgccaaggccaaatatgaatttttatttggcagatctgaagggaaagctcca

SEQ ID NO: 166467 - DNA, 1806 bp, Homo sapiens
  Payload ID: 12780
  Gene Symbol: PSD3
  Gene Name: pleckstrin and Sec7 domain containing 3
  ENST ID: ENST00000518315
  CDS Start-End: 47-550
gggcttcggagaggaaggatggtccaggcgcaccccaggggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaccggtggtggcttttgcagccgtagccaagattaaggctcaggatctttgaggcaagaaggaagaggagctgctaagacagctggacaacctgaaggtagacctgtcccagataatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaa

SEQ ID NO: 166468 - DNA, 815 bp, Homo sapiens
  Payload ID: 12780
  Gene Symbol: PSD3
  Gene Name: pleckstrin and Sec7 domain containing 3
  ENST ID: ENST00000519851
  CDS Start-End: 321-815
ggagggaagctgtgttgagagaggaggctgggaagagggggacgtcctccttcaacttctttcaagttcgtatccctgagcccctgagggatccagtggcattctgggagaatgtcactgcggagtcagtgtgtagcagtttgtacttgcaacagaagcagctttagaagtacattaaaagagcccttgcggaagatgaaagtttgctgagcagatggaatgggagaatgctcttcaattcctgacaaaattatgggcagactgtttgctgacgaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaa

SEQ ID NO: 166469 - DNA, 580 bp, Homo sapiens
  Payload ID: 12780
  Gene Symbol: PSD3
  Gene Name: pleckstrin and Sec7 domain containing 3
  ENST ID: ENST00000517971
  CDS Start-End: 82-423
agtcactgaacttgggagctgaagaatactggacggggcttcggagaggaaggatggtccaggcgcaccccaggggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggaaaatgaatctacattgtcaagtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggc

SEQ ID NO: 166470 - DNA, 8145 bp, Homo sapiens
  Payload ID: 12780
  Gene Symbol: PSD3
  Gene Name: pleckstrin and Sec7 domain containing 3
  ENST ID: ENST00000523619
  CDS Start-End: 165-3113
gggggacatggttacattaaagctaactcccgtcatctcaattatctccttggaagtagttttcacaaatataaaaacgccctacggtggctgttttcggtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaataca

SEQ ID NO: 166471 - DNA, 610 bp, Homo sapiens
  Payload ID: 12780
  Gene Symbol: PSD3
  Gene Name: pleckstrin and Sec7 domain containing 3
  ENST ID: ENST00000520858
  CDS Start-End: 1-496
ggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagtgttgtgggattggagaagatgctgaaaccaaatgggcacctgtcctcagagatcacagactactgagaaatattggaggtgtctttctccataaaataaacagttattccatgttgaaataaaagtataagccaaattc

SEQ ID NO: 166472 - DNA, 6136 bp, Homo sapiens
  Payload ID: 12780
  Gene Symbol: PSD3
  Gene Name: pleckstrin and Sec7 domain containing 3
  ENST ID: ENST00000614430
  CDS Start-End: 145-954
ggtgcttcttaagctaacgcggatcacggcgctcaggagctgctcaggcacaaccccgcagagttcctccagcgtgagagccttggaacggttggaaagtgcctttttatttctctaaaccccttccttagttgaccttcgaaaatgattggcgtgaatagtgtccagagtgccagcaaggtacgggtgaggacctcaggttccgtgaaatactcccgggaggattctatccggcggcagtctcacaggtcaaagtccatgaaaatttccaactcctcagagttttctgctaaggagaacaaggctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaagcatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtcc

SEQ ID NO: 166473 - DNA, 5843 bp, Homo sapiens
  Payload ID: 12780
  Gene Symbol: PSD3
  Gene Name: pleckstrin and Sec7 domain containing 3
  ENST ID: ENST00000615573
  CDS Start-End: 1-810
atgattggcgtgaatagtgtccagagtgccagcaaggtacgggtgaggacctcaggttccgtgaaatactcccgggaggattctatccggcggcagtctcacaggtcaaagtccatgaaaatttccaactcctcagagttttctgctaaggagaacaaggctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacag

SEQ ID NO: 166474 - DNA, 5188 bp, Homo sapiens
  Payload ID: 12781
  Gene Symbol: PSD4
  Gene Name: pleckstrin and Sec7 domain containing 4
  Uniprot ID: Q8NDX1
  ENST ID: ENST00000245796
  CDS Start-End: 196-3366
acattcactgggcaagccgactgtgagccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagcctggagccccacccaggagagtgcccaagggaaacgtgcagccatgaggatccaccggagcctttcgaggagcaaacctgggccactgaccctcctgaacctaccagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagtgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagatgagagggagggtggacacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccaaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggagacctcagaatcattcattcacctacttgctcatttattcattcattcattttgcagataatatgggacgctttctatgtgccagtaccaggggattcacaaatgaattaaacatgtccctgactccatgagttgacaa

SEQ ID NO: 166475 - DNA, 2394 bp, Homo sapiens
  Payload ID: 12781
  Gene Symbol: PSD4
  Gene Name: pleckstrin and Sec7 domain containing 4
  ENST ID: ENST00000409656
  CDS Start-End: 1-126
ggccctgctgcacatcctgtgcaaccttgggcctctctcagccctgagggctggcagagaggaggtcctttttggccccaggtgactcttaactcccaggacagagcaaaggtcctgagcccttagttgcctggaggcttgagtcctgggagcccgctgtctgctgcctctgcaagtgggagaggtcactgcccgagggaggacagggcatgctgccaggctccaggggaggagccccagggagggagcctctggaggtggtgcccaggccgttctcctgcctcctgccctgtgcccgcctcacttcatgttcttcctcagatgagagggagggtggacacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctc

SEQ ID NO: 166476 - DNA, 580 bp, Homo sapiens
  Payload ID: 12781
  Gene Symbol: PSD4
  Gene Name: pleckstrin and Sec7 domain containing 4
  ENST ID: ENST00000409378
  CDS Start-End: 1-537
atgcatcaagatgcagacggcaagaagacgccatggggcaagcgtggctggaagatgttccacaccttactgcgagggatggttctctacttcctgaagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcaccgaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcc

SEQ ID NO: 166477 - DNA, 11234 bp, Homo sapiens
  Payload ID: 12781
  Gene Symbol: PSD4
  Gene Name: pleckstrin and Sec7 domain containing 4
  Uniprot ID: Q8NDX1
  ENST ID: ENST00000441564
  CDS Start-End: 170-3253
gccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagcctggagccccacccaggagagtgcccaagggaaacgtgcagccatgaggatccaccggagcctttcgaggagcaaacctgggccactgaccctcctgaacctaccagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagtgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccaaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggagacctcagaatcattcattcacctacttgctcatttattcattcattcattttgcagataatatgggacgctttctatgtgccagtaccaggggattcacaaatgaattaaacatgtccctgactccatgagttgacaatcttgcccactggtttcctgctctcagtttacagaggcacttttatcttgctggggaagtgtgctgaaaagacacattcccagcccacacccagggatgctgattcagtcagcctgggtcagagggatagataaatatgtttaaagctccttgggtaattctgatgtgtaagtagcagttagctgcagtagagtccaattgcctcatttgattgaagtggaatcccagcatcaagtggacatgacttttggcccaagactgatgcttacaaactaagtggagtaggttatttgacctcactgaacatgcatccttttttttttttttttttttttttttttttggagacggagtttcgctcttgtaacccaggctggagtgcaatggtgtgatcttggctgactgcaacctccactgaatcaagcgattctcctgcctcagcctcccaagtagctaggattacaggcgtgtgccaccacgcccggctattttttgtatttttagtagagatggggtttcgtcatgttggctaggctggtctcgaactcctgacctcaggtagtctgcctgcctcggccccccaaagtgctgggattacaggcgtgaaccaccacacctggcctatgcatccttatttctaaaaccatgataaaaggtgaaagtctgaatgcatgtgtgtgtgacactttgatgctcctttgctcatgtagaaccggcacctctctttcacctgagcacgtggaatcttcagagccagatgatggtggctgcctggcctgccatagtcaatgctgcccaggcacctctgcctggagggtctgggttgtgggctgcagttatgacatgtgaccacttggaggcaggcttgcatctttctagcttctggctgctcaggtgtcctgctgtggagctgagctgtgctccctgaaaggcaggaagttattatgtgtgcccctgtgccatcaccgaaccaggaccttcaacttcgtaaaacccacagtggcctgggccaggactcccaccatctagggaagcctctcctagggaaaagactggggctctgacatcttcctgcagatggagagaaagaaagacatctcagaagtctatggggacagcctacagctccccacagggttgctccaggtaacgctggaaggtgaaagctgagcaggctccagtccccatcctaggtatggaacagatcaaaccaccacaggcctatgtctgaccttgttcccaccccatgctcctctcccacctgtgtccttctctttgcaggagaagggacagacagaggttctcagtgatgagctcaggctctggaagggcacttgaagtttggctttagttcttcctttcccatataggggagctcagcttccagggtcctgggcctgctgtgacccaggttgttactcctgatataactgcttcctgggctctcatgatctcagctgagcctggctttctgctgatgatatttgtttgttgcttgccaggcaccagggtagataaaaagatcaccaagacccgcacctttttccttaggagggtctgagtcttcaggagacggagacatatggaatgtgtcggggttggaaggagcaggactggagggtcggggtgaggggggcagagggaaacagggccgtcagggtggcctgaggccagatcatacagggtctccaatgcagccaaggagagtggctttttgtgaatgtgcagtgcaacttttttttttttttgagacagagtctcgctctgttgcccaggctggagtgcaatggtgcgatctcagctcactgcaacctccgcctcctgggttcaagagattctcctttcccagcctcccaagtagctgggattacaggcatgcaccaccatgcccagctaattttgtattttttagtagagacagggtttcaccatgttggtcaggctggtctcaaactcctgacctcaagtgatccagctgcctcggcctcccaaagcattgggatcacaggcgtgagccaacgtgcctggccagtgcagtgcaatttttaaagagaagagtgccaagctcagggcttggaggacagcctagggattttgttttaagaagatgagctgggcgcggtggctcatgcctgtaatcccagcactttgggaggctgaagcgggcgcatcacctgagatcaggagttcgagaccagcctggccaacgtggtgaaacccagtctttactaaaaatacaaaaaatagccgggcatggtggcacatgcctataatcccagctactcaggaggctgaagcaggagaatggcttgaacccaggaggcggaggttgcagtgagctgaggttgcgccattgcactccagcctgggtaacagagcgagactctgtcgaaaaagaaaaaaaagatgaaatgccttgaaaaagtaaggccaatgggtagggtcagaatatggcctgcaaatgcactgtactatttgtgtaacttatatgtaaatctgaaattatttcaaaataaatacaaaaagaaaaaaaggcaatatcccagaaccttgtgaaaacctggccgtagcaggtcctttttcctcctgctgagctgagcaggcatgctcacagatcctcaaggtttcttgaatggctactgtcctccccactggcccctctgccaacacctctgcccctcagcttttctgatgcccatgccccctcaccagctaactgtggcttgcacctttacctgttcccttcattttcccttctccagaggaagaggtgctctccacaagcctgtgaccaactgttcccctcagccggcacactggctcctcttctcctgcctgccacagacctctctccttcatgggcccactggggctctttgagcctattctctacccccttcattatcatgccttgcaaacaccatcatgagcaaaaatcaaagctggtgttagactctcttgctttccatagctgaccctggcttccctgctttctgtgatgaattcacggtatgtgtgggctttgccaactgttcccagcccttaccaggttcccattcatacctggctctaattcacaccttacaaatcggcgtccaccccacctttgcctgaaatggcacctcctagggcaattgatggctgcagtcatcaactctgatgccttctcagccttcttccgccatcacctctcagcgacctttggccttgatagctatgtgatcatctaccagaccctgcacccaggctcagcctgatcttgccccagtggccaggcccttgagtgggactgccgggaattgagtccagcttttctagccatctgaccgtggccagttagcctcttatgttctgtttgcttctctataaaatggggataataacactacttatgtcacaaggtcctcatgaagattaagtgaaattatgcacgtaaacatctcagaacaatgcctggcacagaagggacacctgtgaggttagctattaattcatagcctcaccagacttaccccacgtctgctcccctcctcctttgggctctggcttaggctctgccctcatgcatgccatcctgcttggatgctgggtagctttgcacttggctctgccttggcctgcaaataacaaatctgagctcaaatgagctttagcagaaaaggactttgattggctccaatagctgaataatctgtatccaggtcaggtgaggcttcatctcgggcttcactctgattcaaggccccttttctctcttgttcttttgggggctccatctcccaggcctatgagcaggaacaaccctcatgcttccaagatggccccaggaactctcaagatccattttcttggtgcaaatatagcagaaagtgactctctgcttcctggaagtttcaaactcaaatccaggaatagtctcctgtagcagcctgccttgggccgtgtgcccatatctgagccagtcactagagccaggggtttaaggagatcagagtccacttctggagaggatgagagtgaagtcagcaccaccaaaacatagggaccagctgtggagaaattgtgagtactggaaggacaggataggaggaatggatgatggggagaaaaccgactaatatgcagatgccctttcctccaagaggccttccctaagtcttcctccttcagtttctattacatgaaactctgtaactctcctctcctctctcctcttcttttttttttttttttttttgagatggagtcttgctcggtcgcccaggctggagtgcggtggcatgatctcggctcactgcaagctctgcctcccgagttcacgccattctcctgcctcagcctcccgagtagctgggactacaggcgcccgctaccatgcccggctaatttttttgtatttttagtagagacggggtttcaccgtgttagccaggatggtctcaatctcctgatcttgtgatccgcctgcctcagcctcccaaagtgctgggattacaggcgtaagccaccacgccccggccctcttcatttctttttgcctctctgcttccagagcaacataaactccctgtgggcaggaactgggattgttgatttccactgcttccccagggcctgatatctagagtcgaaagaatgcacatctcaaaactatgtcctggttctttttctactttcttgcatattctttttcaggcaggagtgcagtggcacgatctcaattcactgcaacctctgcctcccgggttcaagcaattctccttcctcagcctcctgagtagctgggattacaggcatgcaccaccacacccagctaatctttgtattttcagtagagatggggtttcaccatgttggtcaggctggtctcaaactcctgacctcgtgatccgccggcctctgcctcccaaagtactggtgcatattctttttctgtctttcctgctactccctcttgctcttcccacccctaaactatgtagcctcaaagatcttacctggctgactgctgggctttcaagatagtttctggaagaagtctctaaatctaagccttcaactctcatctctgttctgaatttcagacctggaattctaactgtccacaatacatggctcctcaatatatcttcctgaaattacaaatgaccatacggtacaggtgttactatattacctgtaagaccacactcggtgtcatctcctgcaaactagtcctctcctgactcctctgtttctgtgagtgattctgcgatggcttgaggtcatccgtttgctttgaaagatcacacaccaggatacatacagagatgtgacccggatggatggacctttgcctcacaatcagggtagaagcctctggttttcttatttctttgtcctcctctgtggtgtgacacaggttcaggaggaggtacccagacacagaagagatgctttccctgtgcaggcttgctgacagtcttgcccaccactcctggcctcctccctctacatgtccacattcgctgctctgaccctgagttggacccagctaggaattgtgacttcagttactagtatttcctctgagcctctagtcatggtcatgggctaatctgtatatgaaaacccacttgaaagaaatcccagtgctgaagaaagaattgaaacatacagatcgtttctttgctcaagggagtgtggatttcagtgctctcactgagcagaggctgagggtgaccaccttggatcttcctgcaggacacagcccagagaaactgagcctgaatttgctgccatgttttgaggacattatccacgctagtctctttcatctgggccgaggtgggtaattttccttagagtcaagtactagaaaaagttttgcttcttctaagagctggtacattgccctcttgtgaatgagagccatgtatgtgaccacaacaccctttcagttgaccactaagagactgaaggccaattccggatcaactttacagccgcctacggcctgctataccacccatggcatagtttctgtggtctgatgctttattttttattgcattttactaatttatggcatgcatatcatatgagcagtctcaaatcctccccagaacaaggtgaggaatatattaatatttaaaataaaataaacaaaatgtcagtgtg

SEQ ID NO: 166478 - DNA, 3872 bp, Homo sapiens
  Payload ID: 12782
  Gene Symbol: PLEKHA1
  Gene Name: pleckstrin homology domain containing, family A (phosphoinositide binding specific) member 1
  Uniprot ID: Q9HB21
  ENST ID: ENST00000368988
  CDS Start-End: 97-1101
ttgaacagatttgcagtccatgagaaatactttcctgtttcatagggagcttactgttaatatttttattttacagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctgactt

SEQ ID NO: 166479 - DNA, 3771 bp, Homo sapiens
  Payload ID: 12782
  Gene Symbol: PLEKHA1
  Gene Name: pleckstrin homology domain containing, family A (phosphoinositide binding specific) member 1
  ENST ID: ENST00000368989
  CDS Start-End: 109-1260
tgggagccggggccgcggcggcgcgggtgctccgggccgaggccgcggtaaagtttagcttgaagaacgcggccgcgctggagcagggtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagttta

SEQ ID NO: 166480 - DNA, 14010 bp, Homo sapiens
  Payload ID: 12782
  Gene Symbol: PLEKHA1
  Gene Name: pleckstrin homology domain containing, family A (phosphoinositide binding specific) member 1
  Uniprot ID: Q9HB21
  ENST ID: ENST00000368990
  CDS Start-End: 132-1346
ggggacgcgtgcgcagtgcgcgggctggccgtcgcggacgccgctccgggcagccgagcctctgtgggagccggggccgcggcggcgcgggtgctccgggccgaggccgcgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctgacttatttctcattttgtttggttcagcccttgtgtgatgaagtaaatacaatgattaggggtgtgtttggttaattgacttcagtttacatatttaaggacagagtaattatttggtcatctttgcaagaataagaaacttcagatctgtgaattcttaatgcatccctgcatgtgaaattatagaaggaaaaatgatttttttttgataggggaaagaacttgcttatttttcttaattaaaaaacatgttctcaaaagcagaattatcatatgttagcctcagagcatcgtgtggatcatctgggctgctcacagtgctccatgattatttagacggcatgatgtaaggcggaaagcagagggcatcttaatctccgggtgggcagttgagatgcactcaaaaaactatgtcgggtgttagaggctgctccttgcaaacgttccctattggtgataaatattccacgtctgttgcggtgaacaccatatacagggcctagtgcagtgcttggtgcacttggtaaagcttaaatacttctccagtgaggacaaggcattactgtagaatgtgtgaacttcccacattagagaaaagtgtatacctatttgttagataaattgtacttttgaatttctggaatattctttccttaaagcaacttgccttcaatgattcgagataccttcttttgcttgttgtgtctaatccattgtcagatcctgctgcttttccctggcatgttcataccttgttctctgaaattcagccgggaatgactttgaaccagtatgtctgctcacctattcatgtcctgttggggctctcctggactaccctattcctgtcattgtgcagagtaggtatcaaagtagacatcttcatctgttgccttttcctgaaaagctgaatgacgacttaaagatcagctaggccaagcccccaccatcaatgctaactgagataaattgagaccccagaaaggaggaggatttgcctggcccatggggcacgttagcaacgaagctgtaactgttggcttctcactgtacttgggagcatcattaggatctgtgcccagggtgtagctagagtaatccagccaaatataccaggttgcttcctaataacctatggcattccgcacctcctctccaaaacacataggcttagtgttctttttttttttctcagtctttttctgaaggccatttgttgtgtgaaatggctttcttcatcttagaccttcagatctctgttgaatcaagtgacttgtgaatgtctagccatgcaacagcagctcacgtacttcctgtgtgtgttctaatatgctgctgctacaaatggatggaatacattgtcctagaatgcaaggaccttgaggtttgtgtctgcgtttcacctgttaggttttctgtagttctgttagacgatggatatgtttatgtttgatacccctttattgcagcatgttcagcactttcaaaaaggagagcatttagtatttggttctatttaggaagggcttttaattatttccaagaacttatctaggtttagcaaatgaagctttaatttttttagtatgtcctacctatttttctgaaatattattttcttaccaaaagtgccattgcgtgtgtaagccatgttttcttgttcacgccagccatgggaggtgataatagcctgggtaacaatttcagtcatacttgtccaggagcctgcttccttgaaagtgactgatgttccggtgttcctttctttcccattgggtcttggacacctgattgttaccatggtgtttgtccactgctgctatggtcttgttgatgctgctccaaatatgtagctgtgttttctggatacataatttttatttaaagcttattcctggacacattttgtccatttttgaaaagatctaaactaatttgactagtagaattaggctaacaatacatggttcaaggaaaaatactgccttttgtaataaaagtttcttcttgcctagtgtctcattggtctgaatataatggctgtcttagacccggcatcctggcgcctgtcttcaactctagttctgccgtatgtgactttaggcaagtgtgtgtgtttcggaacttcattttctacattatataaaatggaattggataaaagctacatctgtcttggtaattattattattaactgatgcaactttttttcctttgaaaagtattttttttattatttaagttttagggtacatgtgcacaatgtgcaggttagttacatatgtatacatgtgccatgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtcgatcattgttggacatttgggaaaagtatttttaatgtttttatcctaaacccaaaataagaagggaaagctgtaaacatttttgctttaacaaaaaggaaatccctttcttagcttttctttcacttctagttgcagttcaggaattttctgtaagtggtgcttgtacctttatcaaaagttctgttaacagttggtgaggcaagaaatatttgtatcaaaaatgcaaagatatgacagcttaataccagatctcagtgttcagaagtttagtccatataggatttgtgtatgttatctattttttaaatgattaaattgtatgttttaaacctcaagtaagacacatgttgaaaatatggctgaattgaggctagcatttacagttttgattgatgaaatctgtattttttgatacatttaatagtgccttactgtggtatattcatgtggtaatagcgccaccttctggttatatcattgctaaatttaaaatttggaaatttggagtctgtttattgcctccatcgtagaaaattagataagatatgtgattgcctaggatagttttgaaattaatataaaattcaaactaacatttacaaattataaattttttatttagagatgattgtaggttcacatatagttgtaagaaataaaactttccaaactttcaaaatggggaatatttagtatttggtcctatttggaaagagctttaattatttccaagaacttacctgggtttagaaaatgaagttttggttttttaattatgtcctacctgtcaatttctgtttctgtaagaaataatgtagacccacacgcctgtagtcccagctattcaggaagctgaggcaattggaacacttgagcttaggggtttgagatcagcctgggcagaataatgagacaccatctcaaaaaaaaaaaaagaaaagaaaaagatattgtgtaccctttactcagtttccccccaacagcatcttgaaaaactaatacaatattataaccaagatactgacactgatacagtcaagatgcagaacagttccatcatcacaaaggcccctctttgttgttctttttatagtcacatccatctcctattctgcaggtttggaagcagacttagccacttgtccagagtcagattaggcttgaaatgtatctttctgataccaaagtttgggctcttaacacactacttctactgtctcagtagaagtcttgaaaacttctcttttaaaatagtacttccagattactaaatgagttgaattcagtctgttttcaacatttctagaaccatactatttcaaatgacatattatttatacatacctttaaatttaacatttgagaatcaatcataggtacgtatcaaattacaacttccctgaaagatttcaagccctgacatttgataaataaggttaccagaataaatagtaagtaacagattgaaatagctttaagatgctggattcttgctttggaaacagctatagggcctggttataaagataatcacttggtataggctaacaggttttttccatgtggagaagctttgacctgatggagttgggtcaattggtgtcttcagtgtacgacatgcagcacacaggagacctaagaagacgacaaagatgtccacgaggaatctgccgaaagaaaatataaagtaatatgtgataaaatctagcatggaaaactacgcatcagagactgagatggcccatgggtgatggtgtgggtaagataagtgttgtgatggagagggcctttggggggtcccatgagagaaaaaggtacttctaagtaaaagccatgtgactttataaatttctaaatgttgattcaggggtcctaagtgatggagaaagtttacattgttctcttaaggctccattgcctctttccctcccgaactgtggtatgtatacctctaatgcacgttttctttagtggggaggaaaggaggggctgtggagaactttccatggtcaggaacttacatcagccttttttttttttttttttttgcctgtctttggtaccttatcttcatgttatgaatgtaacctattccctgtggaaacatttattattatttccaaatagggcctttggtcccaatggcgtctgtttctttttgacttctacatacgtcatgctcacggtcttggttcgtattgtcactcatgccattttttcttcccatttgctttttgcctgtctagtttgaaggtggaagattttccgatgaatcagatatggcaagtgaaaggaagtgaagaattaagggtaatgacaaggttttcagcccgaacaactagaagccatgaactgaggtagcaaagattgcaggtagagcaggtttgatggaaaagatcatgattgcagtattggttgcagtattgagtgttagggttgacatgtcagacatccaagtagaaatggcaggcaggcagttggatatgcaaatttggaattgagagaaatcattattggaaataaaaatgtgggagtcttcaaagtattcggtgctattgaaggctttgaaactggatgagatcatctttagagagaatgaagatgaaagaagaaaagagaaccatggaatgagccctggggcgctccaatattaagagctttggaagaagaggaggaagtagccatgatgaatgagaaggtgtgaccaccacatcaacaggatatcaagagtacgttgtgtcttagaagccaagtgaagaaaatgaagtgaggaggagatcggatgtttcaaattctgctcgcaggtcaagttaagaggcagcctgagaaatgccctttgtgtttggcaacgtggacagtacagatgtcattggtgatcttgccagggcctgttctgatggagtggtggggacaaatagaactctttttgaggcattttgctgcaagaggactggagaaaggtgacggttgctagtagcaaaagtagtcttttcttcttaagacagtggcttggccagacacggtggttcacgcctgtaatcccagttttggaggtctaggtgggagaatagcttgaatctaggagttcaagaccatcctgggcaacatggcaaaatcccatttctacaaaaaatacaaaaattagcagggtgtggtggcgtgcatctgtagtcccagctacttgggaggctgaggcgggaggatcacctgagcctggggaggttgaggccacagtgagctgtgattgtgccactgcactctagcctgggtgatagagtgagtcactgtctcaaaaaacaaacagaaaacaataacaaaagatggtggcttatttgttgatgaaatgacccagtaggaaaagaaagattgatgatgtagaagagtacagaattgttggaacaagtccttgaggaggtgagatgagatggaagctagggcacaagttggcttgacttcttcaaatgcacaggtgtttatctggggtaggaaggcacagtatgtggtgcagccactggttaagtgggtagacgtggaggggtaagtctctgaaagtctctgccttagtctcagtaaactaggaaacaaaattcgcaactgcaagtaaggtggggaaaggtgtgaaaggcatgagagaatagatgtctaggattggggagaaggaatggactagggacatttaggatattctgagcagcactgaaaacccactgagctctgtgtgcatgaatgacagtgttcaataactgataactgtagtcatttttgtcacgctcctgacttcagtggaaaagcctctagtgcaggcatgtccaatcttttggcttccctgggccccagtggaagaagaagaattgtcttgggtcatacatgaaatacactaacattaatgatagctgatgagctaaaaaaaaaaaaatcgcaaaaaaatctcataatgtttttaagaaagtttacaaatctgtgttgggccgcattcaaagccgtcctgggccacatgcggcccgtgggctgtgggttggacaagcttgctctagtggttccccatgctgctggcttttgggctgagaaatattttatcaggttaaagaagtatccaactattcatattttgttgagtttttttcttaagaatggtgattgaattttgttaaatatcttcaatatgtctggaaataatatttttatccctctttaatttggtgaaagctgttaatccagttctcaatatttaaccatcattacatttctggaataaatcccatttggtcaagatatgttattttaaaaatctgctagattttgtttgctattagggatttttgcataaatataaatgatactggtctgcatttttcttttgtgtagctctagtctttgtaggttttgtggtgttttactagcttcatagaaaatacttgaaaggtttttttttttttttaaattttaagctgttacagaacagcttcaaaagaattggtattctaggctgggcacagtggctcacgcctgtaatcctagcattttgggaggccaaggcatttctcaggctggatcacctgaggtcaggagttcgagactagcctgctcaacatggcgaaaccctgtctctactaaaaatacaaaaaattagccaggcatggtggcaggtgcctgtaatcccagctacgtgggaggctgaggcaggagaattgcttgaacccgggaggcagaggttgcagtaagctgagatggtgccactacactccagcctgggtgacaagagtgaaactccatctcaaaaaaaaaaagttggtattctatactccttaaagagttagtggacttccgctaggaaatcctctcaacctggtgctcttttgagggtgtgccattgacaacctcctcatttcctctatgagaattgatatgcttaggctttctatcttttctggggtcagttttgatcaattatatccatagaaaattatacattttatctaagtttttaaatgtatttgcatggagctgagcacaatatacagaacttatttaaggagaaatgcattactgcagatcccactttgttcttcaactcaaaatatccaatgctgtgaagattgcttatatgacaagttgtgctatcttctgatttttacctggaagcaatgtgatcacaaacataccaccagattaaagtggtagtactcaggtaacaggaggccatccaaattaaatttaggagtctttaaaaaattatcaaaattcaatgtaaaaagtataatttcttgtaaagaacatgtggttcctggagaacatgtctaggttccccatttgagaaacactgtcctagtgaatagcatttgaacttatcctacgttcattgcccttccatgtccaccttctcacacagtgcttctgtgtatatctggcactccagttcaactgaacctttccatctccctgtttcccaccttcctgctattatttgtgctgtttcttctgcctggaacgccactttcctaataattgttgcctgttaattccacaccttcaattctcaccaaaatgccactttctccttgaagtgttggaattgctttctcatctttcccatcacacaagccttggtgaccccaaaacactggattcccttctcccttcccatgccaacgttcagtacagttcattggaacagaattcactttaagctttgctcttaaactttggcctagtaaatagcttttctcctttcactgtagtcccttttaaaagccaaagacttcaaaatttggaagagattagaaaatgaaaacagtccaaatccagctctttgttgattagattggcccaaaggggacataaataagacaagcaaaatgcaaacgaattctagtagtaatggccactgtataagcactgcaccagtgcagtggtttcagcagctggtcctgggcccctttcatacttaatgtatgtttggttttacgtttaattttaggtgctaacaattacctcatgggcccctcttaagtctgctgtgagagaaatcctaatcccctaaggcagtggttctcaaagtgtggtccctgagaccaacaatgtcaacattactgagaacttgctagaagtgcaaattattgctcccatcccagtcctactgaatcagattttctgggattagggcaggcaatctgttttaacaaggcctacaggtgattctgacatccattaaagtttgagatcggctgggcatggttgctcacacctataatcgcagcactttgggaagccgaggcgagaagattgcttgagttcaggagttcgagatgagcctaggtaacatagtgagacatcgtctctactaaaattcaaaaagaattaggcatggtggtgtgtgtctgtagtcccagcgacttgcattgcgtgctgaggtgagaggatcgcttgagcctgggagatcaaggctgcagtgagccctgagtgtcactgcactccagcctgggcaacagagtgagaccctgtctcaaaaaaaaaaaaagtttgagatcctctgccctaagatatccattatccattacatgtaaggaattaacttctctcctatgcgaccaggatggcctttgttacatagtatccttagagctgagaaaacagttacctaaatcactgcctgtgttctgtggttcagataaagaacccactgaaagaggctgcgtgcatgaaccggctctgaccaactgaacatgaaacacaggttggaataaaaatatttttttatttgatggtcttccatatagacagaatttcatcaggaatcaaagaaaggtggttaccacatataaacaccaactaaactctgagctttctggcaactgaaaaggaaaacgttgagttctagaatagcctttgttgtttgatgcaactaaccatatcaccttttagagctagagaaccgtccaggtattaaatgtttggaatcttttatgatgtggattgtgctacaggggacactgagtaacgtggggaccaatgtccttcacagtttttgtagaaaaatttttaggtggtcttccatattcacccttagaagcaaggacaacccttcgagtgtaattccgtggagatgatttccttctgactcaaacacccatagcttccctgtctgtccatttcgtgagctcctcattaccttccatgactcacttttccatgtgacacggagcctccctggcttccactgctgatactgaccattcctttctttgttctctatgctgccgtggacacagagccaccatcgctgttaactgtactagagtctttactttttttttcttttgtgagcctaagccttcctcaagacaagaatctttgttttgtttaaaaaaagaatagccttaatgtttttttttctgattttaaagtgaacaccctattgtagaacatccatgtaagcaaaaagaaaaaaaataaaaatgatttgtaatttctccaagaaatgacctgtgttgacatttcagtgattatacttccaagtcttttactaaatgtgtacgtaaatagctttatttttgtgtgtgtaaaaatctgtagcctctgtaaacaagccaaatgtcatatacaccccacacaaaacaataaaagcaaaaatcaccaga

SEQ ID NO: 166481 - DNA, 3221 bp, Homo sapiens
  Payload ID: 12782
  Gene Symbol: PLEKHA1
  Gene Name: pleckstrin homology domain containing, family A (phosphoinositide binding specific) member 1
  Uniprot ID: Q9HB21
  ENST ID: ENST00000392799
  CDS Start-End: 1466-2680
attttacattgagtcagtgatccatttgagttagtttttttcctcatagacagtcgattattccagtcttgtttgttgaaaagactgtcctttctctacaaaattgccttggcaccttggttgaaaattaactgttctctcttcctgtttactagaagaatttttaaaagaccggtgttatttttttccttaagggattggtagaattcacatatgaactatttctaggctttgacttttctttttggggttttagtagtgaattcatttgctttagtagaaataggtacttcagattttcttttttgtcttgtgtcagttttttcaaagttgtgttttttcaaagaatttgtttacttctaaattgtcaaatttgtttgcatgaattcttattacccacttaatgtctatagggtgtgtagtgtgtacttcctaatattggtgatttgctttctctctttcacttggttcacatagctatagatttatcaatttgatcttttcaagaaacagcttttggttttaatttgtattgtttgttttcaattttattagtttcttttctgatatttattattccctttctattttgggtttactttacctttttctagctttttagggtggagtttatgccattcatattagaccttttctaataaaaatatcttaagactataaattttctttcaaaatcacctttagctgcatactacaaattttgacttttaaaatttttcatttagttaagaatgttttctgatttcccttttgatttcttcttttacccatattttatttaaaagtgtattttaattttcaaatagctattcaggtgataatttcatctatagcactaaaaaccaatgaaaattctgacatatatttgtttataaaattccttgaatgctctgtatattgtatttatatggtatatacctgagggcttttctgtagcataaaagaacagttcattatttttcactgttctctgggttgaaggagctcatttgggcagctccatcttgggggtctctctcttgtagttgcagtcagatggcagctggaatgagagtcatctgaaggcttgactgggctggatggtcaagatagcctcttcactcactctgctagaatgactgggacagctgggtgtgggctggtcacctctctccgcacagcttcttcatgggactagttggctttcacacaacggggcagtctgaaggcagtcagatttcctacatgacagctgacttctagagtgagcattctaagacattgagttttttcaagtagataatttatttgctctactctttcaaactaagaagtaagataaatgtatggggccagtcattgtagaaactgcctgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaa

SEQ ID NO: 166482 - DNA, 3704 bp, Homo sapiens
  Payload ID: 12782
  Gene Symbol: PLEKHA1
  Gene Name: pleckstrin homology domain containing, family A (phosphoinositide binding specific) member 1
  Uniprot ID: Q9HB21
  ENST ID: ENST00000433307
  CDS Start-End: 74-1288
gaaatactttcctgtttcatagggagcttactgttaatatttttattttacagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctgactt

SEQ ID NO: 166483 - DNA, 617 bp, Homo sapiens
  Payload ID: 12782
  Gene Symbol: PLEKHA1
  Gene Name: pleckstrin homology domain containing, family A (phosphoinositide binding specific) member 1
  ENST ID: ENST00000463663
  CDS Start-End: 219-617
gcgctggagcaggggtggtggacggggccaggcgcgaggtggcggcggctgcggggctgccgggctgctggagcgcggttcccgctgtggcgagcggggaggcgtccgcagaggggcggtgggtgctgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaa

SEQ ID NO: 166484 - DNA, 565 bp, Homo sapiens
  Payload ID: 12783
  Gene Symbol: PLEKHA2
  Gene Name: pleckstrin homology domain containing, family A (phosphoinositide binding specific) member 2
  ENST ID: ENST00000519640
  CDS Start-End: 221-565
gcagacccagaaatccctggagcgcggcggacccggcggccggaggggcgaccccgcccgatgtaacgcgccccgcccgagccccggcccctgcacggggggcagcgaaacttctctgcgggttctggcgctggggcaccgaccccgcaacgactgcccgggctgcgggaggggaggagagcagagaacgtccccagggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcacc

SEQ ID NO: 166485 - DNA, 2127 bp, Homo sapiens
  Payload ID: 12783
  Gene Symbol: PLEKHA2
  Gene Name: pleckstrin homology domain containing, family A (phosphoinositide binding specific) member 2
  ENST ID: ENST00000521746
  CDS Start-End: 235-984
aatgcgaaacgtaattaacccggaaaaaagagccgagggacgggagagaaggagggggcactgggggagaccagagcgaggggagcgagaggcgcggagagtttggcaggcagacccagaaatccctggagcgcggcggacccggcggccggaggggcgaccccgcccgatgtaacgcgccccgcccgagccccggcccctgcacggggggggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgcagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctact

SEQ ID NO: 166486 - DNA, 5582 bp, Homo sapiens
  Payload ID: 12783
  Gene Symbol: PLEKHA2
  Gene Name: pleckstrin homology domain containing, family A (phosphoinositide binding specific) member 2
  ENST ID: ENST00000617275
  CDS Start-End: 179-1456
ggcactgggggagaccagagcgaggggagcgagaggcgcggagagtttggcaggcagacccagaaatccctggagcgcggcggacccggcggccggaggggcgaccccgcccgatgtaacgcgccccgcccgagccccggcccctgcacggggggggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccaccccagagaaacgtccttttctagatccatttctttgacccgacctggaagctccagcctttcaagtgggcccaactctatcctgtgcagggggcggccacctttggaggaaaagaaagccctctgcaaagccccctctgtggcctcctcctggcagccctggacacctgtcccccaggctggggagaagctgcttccacctggagacacttcagaggactccttgttcacgcctcgtcctggggagggcagcgctcctggggtgctgcccagctcccggataaggcacagatcggagccccagcaccccaaggagaagccgtttatgttcaaccttgatgatgaaaacatacggacctctgatgtgtgatggagcacagtgccatgggagggagggagggagggaggacttgagagaaggaggctgtgactcagtttctctaccttgttggagggtagtcagaggcctttatgtcactcatattcctgtggatgctctttgggagggaggggcccatccagctgggctgtgtgtgtgtgtgtgtgtgtgtgtgtgtgtgtgtgtaatatcaacgcagtgtatttaatttggggaagtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgcagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaacctgggaggcggagcttgcagtgagccaagatcgcgccactgcactccagcctgggcgacagagcaagactccatctcaaaaaaaaaattatctgataggttactattgctaaattaattggccattataataagctgatttgtttcttattcagcaagatctcttttgagaatgtgacaaattaaacatacatagaatccatatggtattatcctgataaagggaaacgaggacactaagactgtcaaatggaaatcttcttgtcaattggcaaacacttgggaattccacattagagcattgcttgtttttaattttttttttttaatttttaaaagacagggtctcactctcttacccaggctagagtgcagtggtgtgatcatagttcatcataactttgaatctctgggcttaagcaatcctcccatgttagcttcccaagtagctaggactacagggttgtgctaccacgcctggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcaatgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcaaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactg

SEQ ID NO: 166487 - DNA, 1748 bp, Homo sapiens
  Payload ID: 12783
  Gene Symbol: PLEKHA2
  Gene Name: pleckstrin homology domain containing, family A (phosphoinositide binding specific) member 2
  ENST ID: ENST00000616927
  CDS Start-End: 177-1304
agagaaggagggggcactgggggagaccagagcgaggggagcgagaggcgcggagagtttggcaggcagacccagaaatccctggagcgcggcggacccggcggccggaggggcgaccccgcccgatgtaacgcgccccgcccgagccccggcccctgcacggggggaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccaccccagagaaacgtccttttctagatccatttctttgacccgacctggaagctccagcctttcaagtgggcccaactctatcctgtgcagggggcggccacctttggaggaaaagaaagccctctgcaaagccccctctgtggcctcctcctggcagccctggacacctgtcccccaggctggggagaagctgcttccacctggagacacttcagaggactccttgttcacgcctcgtcctggggagggcagcgctcctggggtgctgcccagctcccggataaggcacagatcggagccccagcaccccaaggagaagccgtttatgttcaaccttgatgatgaaaacatacggacctctgatgtgtgatggagcacagtgccatgggagggagggagggagggaggacttgagagaaggaggctgtgactcagtttctctaccttgttggagggtagtcagaggcctttatgtcactcatattcctgtggatgctctttgggagggaggggcccatccagctgggctgtgtgtgtgtgtgtgtgtgtgtgtgtgtgtgtgtgtaatatcaacgcagtgtatttaatttggggaagtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaat

SEQ ID NO: 166488 - DNA, 3594 bp, Homo sapiens
  Payload ID: 12783
  Gene Symbol: PLEKHA2
  Gene Name: pleckstrin homology domain containing, family A (phosphoinositide binding specific) member 2
  ENST ID: ENST00000616834
  CDS Start-End: 291-1421
aaacttctctgcgggttctggcgctggggcaccgaccccgcaacgactgcccgggctgcgggaggggaggagagcagagaacgtccccaggcaagtcccttgggtacggattgggccatggagactcctctttcactcccccgactaccttattaaatgacaggcctagaaggctcccctagggactcctgtcctttcctctgggtgcagcctggacttcgggcttctggaactccagacagtgaaaaggactgccctaaaatgcagggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccaccccagagaaacgtccttttctagatccatttctttgacccgacctggaagctccagcctttcaagtgggcccaactctatcctgtgcagggggcggccacctttggaggaaaagaaagccctctgcaaagccccctctgtggcctcctcctggcagccctggacacctgtcccccaggctggggagaagctgcttccacctggagacacttcagaggactccttgttcacgcctcgtcctggggagggcagcgctcctggggtgctgcccagctcccggataaggcacagatcggagccccagcaccccaaggagaagccgtttatgttcaaccttgatgatgaaaacatacggacctctgatgtgtgatggagcacagtgccatgggagggagggagggagggaggacttgagagaaggaggctgtgactcagtttctctaccttgttggagggtagtcagaggcctttatgtcactcatattcctgtggatgctctttgggagggaggggcccatccagctgggctgtgtgtgtgtgtgtgtgtgtgtgtgtgtgtgtgtgtaatatcaacgcagtgtatttaatttggggaagtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgcagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaacctgggaggcggagcttgcagtgagccaagatcgcgccactgcactccagcctgggcgacagagcaagactccatctcaaaaaaaaaa

SEQ ID NO: 166489 - DNA, 13880 bp, Homo sapiens
  Payload ID: 12784
  Gene Symbol: PLEKHA3
  Gene Name: pleckstrin homology domain containing, family A (phosphoinositide binding specific) member 3
  Uniprot ID: Q9HB20
  ENST ID: ENST00000234453
  CDS Start-End: 403-1305
gaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacacatcatataatacattgtattttttacattcattgatattctgtctaatctttattaggcactaatataattctaatggatttgagtttgtttgtatatttaggcctgctggtgaagacacaaatgaagcataatttttgttgcctgtgagcttagaatggtgtgacctatttcattttatttcaatttatcttgtaagtttatgtgggatattttaaaataattaatatttggtatttgtttaaaaaactgtaattataggccttccatcttaagtttaagatggacataaacagtctatacattaatatgtgtttgggtaaactgtatgctacttgaagtgtttgtaattttaaataacacacaggtcatcagactactctatattcagtggagtctttgcctgctcataagttgtacttcatatgtctaatttgaaaaaaaaagtttgataatgtagtaagttatgacgttgagcaggtaatcaggtttttcttgttttttttttttttttaaattttgtagtaagaacttgcacagtattaagaccatgaaggtcagggtgctattgattgggagttttttctggtagtgagtttttttgcagtaataggtttataaggaaaacaccgtaacaagcttttgaacttatagaaaataatcacatccattttctattgctttacccaaatagatgggttcgtgaagagttttctgtgaatattttaaaaatacaatgcaattatttctggtttgtatcattttttcccccttaaaacaggtccttgaacaggtttgcggtatccctaagtatgtcttttgttatgacttggagccactttttgttgttattgttaggaaccaaacacatctgtgaaatcattttttttgtgggagtataaatatatcttgaattatatccaggttttgatcagtgaattagtagcatgaagaaacctataaagcttaagggaaccttgcattttgaggagtcctttattttcaagtgtgcctgacttttttgaattttaagaaaaagatgaaccatataacaattctgtaagaattttagcttgtcaagttgttctatactttatagaaaaattattggttattattagttattagtagtcccttttttttgctttgtctaggtcatggggttattgagaaacatgaaaagttattgagaaatttggaggttctcttggcagcctatcagtgatcttctaagcaaaagcagtgcttgtttttcatttcaagtgcttgctcactattctttgggaatcgcaggcctccatgactaaagggattttgatacaattcttttataaatgagctgaatttgaattttcttacatcatatgggattattgcatgatcttcagtcaggaaaaatccagaaatggatgctattgcttaaacttaaattccaaggcagaagatagagtatcttcatttccacagatgccctagaacctttgaccttgaattgtagtttttcagtatgtattatcacatttagaaatgtaaaaatcacaagatctcaggaaatgcgcccttgtgatatgttaataccagattgctgtttacactaattccatatacatgataataccactaatttggactctgctagttcttttatttaataaggcacctctaggtctgtactttgagccttgatctgggtacttggtacagagggagtgtcctggcctgaaagaaagccagattaggctgcaggagttcctttgaggaggtctgtcttttaataaccctggcgggtaaatgaatggtaggtagctggtaggtaggccttcttgttcatgtctttctgtctccccaatccactctttgaattcatgttgaattcttaacttgaaattctgttgttttttttttaattttagctttctttttattaaactagttaatgtacatagtttgaaaaaatcaaatagaactaaaaggtttatagtgaaaaagtgtagttccctcttccccagtttagcattccaaagacaaacacttggaactcttagtggtttgtgttagtatttaccttcctgtttgaaaatgttatactactttttgttgacttatcaatttcagaaacagtttctcgaataccttttatggtagacaggatttactttacttaaactctccacctcccacatttttcttcccccacccctcccaaaatagatttatattcacacaacttttagttagaacaaactttttgtgaaatagatagacataaatgtagttcactgatgtaccacatggttaactatcattatttcctttttactagaatgttattttttctggggttggtattgcctgattttcaaatttgcttagtttttaatgtacctgtcacaatgactatccaaaggcttaaatgctgaaaaacatcagataatcgtatcaattctcttaaaaaagtttttaaaaatattttgtcatcctttagggacatttcttccacagtccttcatcttctgccatttgtactgttgccctccaggcctgttctatggttcagcagtcattctgaaactccctttagtttttagtctcacattaggttttttttttttttttttttttttttttttttttttggcaaagctcctccaccagtaacttcctaagaaaaggtgcatagaaagtaaagattttaaggctttacaggtctgaaaatgtctctactcttgattggtagtttggagtctggaaaataacatgccttcagaattttaagggcaacatttcattgtcttaaggcatttagtttttctgtgagaattctgataccgttcctttacctgggatctgtttttacactctgtaagcttttaggaacttctcattacttctgatgtttcataataatatgtgggtctttattcattcatcttgatggctacttgacttggtggaatctttcaatttagagatttgtctgcttcagttctgggtgtgtgtgtgtgtgtgtgtgtgtgtgtgtgtgtgtgtgatctttttgacagttttctctcttccattttctttgttctatctttctagaatttctgttatttgaatgttggacctcccagagttggaccgcctctaaatttaaaaagctttttctctctagttgttccttaagttatattatctttgttctttttgttatcctccagctcttctgttgaattttctttatatatatattttaatttctaagaggtcttttttttctgtttcatttcataaaaacctatttttattttatagattaactgtttccccatatctccctgaggataaaattaagatttttttcttacatctttcctgtttcttgaatggttctccccctcccccaccatgtttctgctttctatttatttgttttgggctctttcattctgaagcctttcttagaaatcatctattcatattagtcatgtattaaaaagctaatgtcataggtctttatatgtgggcagggtttataagttgtctaaagggccatcaggtagagttggccttttctgttgaggtcccctaaatttcagtggaggtcttctctttggggccagtttctctagaaaactgggtcctgatagtagggtaagaaaagacagctgaggaccccaagatttgtatgatgacttttacttaatccctctatcttcatcctctctcatgcccatccggccccaccccccaaatcctcctctggctgctgaccctcaggttcagtttttcctgtcagtggaggttgagggtggggcgtaggctggctgtggagagtaggggagaggacctgggttccagttgctctttatacagacttctagtcctgatttcagccctatacctcactctcatcttctacaatacctagtgcttccaagtcctgaacttagtagaggtttggtggggtgtgtttttgggcttctcccttttgggtacttaggctttaacttcctccactctgctaggttaggtattgcacttcctcctggtttttatctgtataaactttgttaaaatctcatggctttgtcgtctgtgcttttttgtggattaatactatttatattcctttaatatcttttggtggtttggaggtagaggaaataaattcatgtggttggtttgtatgtttcactgaaagtctagatttaaattctaatagtgtataaaaaataaaaattctttagtattaatttgtaattcattctagtgatttttaattcatatggttttactgtactacctacctcatagggttgtgaggattagaagaatcaattcataaaaagcagttagaaaagtgctgggcacgtagtgtgttgaataagtgttagttattaatattgtttactatcattattattattactactatcagtttttttttttttttctgagacagggtctcactctttcacccagtcttgagtatagtggagtgatctcagctcactgcagtctcgacctcccaggctcaaatgatccttttacctcagcctcccgaataactaggactacaggcatgcaccactactcctggctaatttttgtatttttttgtagcagcagggttttgccatgctgttcagactgatctcaaactcctgggctcaagggatctgcctgccttgactttccaaaattctcggattacaggcatgagccacactgcactctcctatctctctcaattcagtaacctgtttattcttgagtgaaaatgtttcaccataggaagaattactaatatatgggaaaatctagtgtttgataatgttgaccctacattttttttggacagtctctgtcgcccaggccggagtgcagtggcgcgatcttggctcactgcaacttccacttcctgggttcaagcaattctcttgtctcagcctcctaggctacaggctaggactacaggtgctcgccaccatgcccagctaatttttgtatttttaatagagatggggtttcatcatattagtcaggctggtcttgaactcctgacctcaggtcatctacctgccttggcctcccaaagtgtcgggattacagatgtgagccaccgtgcccagccgaccctgcatttaactagacttcatatgaaatgttcaggtgttaggtgttatctttctaagaaacattcaagccttaagaaatccaatcagttatagttactttaaaagttttaaaaagagtataacaattttgatgtgcttttaagctttattggtattatattttgtttttatcatataaatatgaagtataggagataagataatgcagatgatgtttgttatgccttacctaccgccagtagatgtaatactcttaatacatggagtacagaaatagtagattcccttcattcccagtgcaacagtgttgggaggtggggcctaccaggaggtgtttaggtcatgtgggtaccaccctcatgaatagattaatgccgccgtgtaaagggcttgtgggcgtgggtgaacactctcctgctcttctgccaaatgtctctcccttccaaaggacgtagtgctctacatagtgttggaagcgagagactgagccctaacatgccagtgccttatcttggatttctcagcctccaaaactgtgaaaaaataaattttcattctttatggtaaattcccatcactgtatccataacctcttgtaaatagttgtacacctttcagaaaatgttgtggacttacataagcaaaatgcctgcatttatttcataggtaaaattttaatctattttctaatcaaagtgttttggggaacatttaatttaaatactatgttcaatttttttaatggtctgcttcagattttttttataagttaatgttttaaaacaaaataattgtgttctaggtagaagctactctgagtttaggtttttaaatctctttcagatattttaagtatcttttttgtgtctggattcagagaggtatgataatgagattctcttctagaggggaagtgggagtaggtaaccatactactctttctacggctacagagccgcatactcgaaggagggagatttttatttgtaaggacatttgtattatctttcattaaagtagagtcccatgggcgtggcaaatggctgtaaataaagtaaaagtggctaaagaaaacagtgcctgctattagcttgatgctggcattttcttctttccctggatgtgactgttattgtctttattgggtccccttattatctgctttgatatccatctctggaactttgatctctaattttttttttttttttttgagacagagtctcactctgtagcccaagttagagtgcagtgacacgatcttggctcactgcaacctccacctccggggctcaagcaattctcgtgactcaacatcccaaatagctgggactgtaggcacgcaccaccatgcccagctgatgttttgtatttttacaaaaatttttcaccatgttggccagggtggtctcaaactcctaagctcaggagatccgcctgcctcagcctttgaaagtgctgggattacaggcgggagccaccgtgcccgacctgacctctccatctttggcgtccttatgctgcctcttctccaaatacatgttggccagggtggtctcaaactcctaagctcaggagatccgcctgcctcagcctctgaaagtgctgggattacaggcgggagccaccgtgcctgacctgacctctccatctttggcgtccttatgctgcctcttctccaaatacagtaactaatctagtatattttcataggatagaatttgccctttctgtcccataatatgttcctcttccccaaaaagttttttgttggtctctttggtaataaaacatttagagcatttactgtgggccaggtgctttacctcatgttagccttataacagagatgcggaagtacaggactaccagtgcagccaagatgcacagcaccaggattaactcatgagactgattagaatgatgaatatcttattgtatcctgaaacattaagcctttaagttatccctttatttagtatttaaattcacatgcttcttgatttttttggactagcattagttgttgaataaataaataattcagaatgtatccacaaaacctagaatatatgacagggtggattcagttttgcttagttactgtagataaaccaaataaattaatgtaaagggatattaatgcattaagcaattttttttgacataaatgaagggttgtttccatgggtaatatattcagaatattaaagatgagtaaaatgtatgactataatgaattccttcttcacttttactctggcaaggtgggaggagggtgctgttgataatctctgtgcttttgcaagtttggcacaaagacttttactcacttaaatctcaatataaagtatattgccagatctggcagcatggggacaattaggaacaaaggagagagaatagaatcagccatcaggagctataaccacactcttctttctcaaccttttctggtattagtaggcagaactccttttggatgcggtgaagcattttatgagtgaacaatggtgagtcatgtaatgaaaggagatgttctaggaaaacttttcagtcccgctcagtgctgccatctttttctcccagcactctggacttaaaattctgagagaacagggtatttcccacccttcctcttactttttgaaagcaatacctgagttattaagcaatcatttagacagtatgaataaaccaaaattcaccttgacactccatcccctagaggtaaccattcttttctagtatatattcttccagacctttttcctgtgtattgacttttaaatagatgtacattgcaatagtttggattagctcatccatagcagggtggttaaataaacagtggcacttttttttttttgagacagagtctcaccctgtcgcccaggctggagtgcaatggcgcgatctcggctcactgcaacctttgctttccaggttcaagcgattctcctgcctcagcctcccaagtagctggaattacaggcgagcaccaccatgcctggctaatttttgtatttttggtagagacggggttttaccgtgttggtcaggctggtctcgaatgcctgaccttgtgatctgcctgccttggcctcccagtgtcaggatcctggccccagtggcacatttttatgatgcatctggtactaaagaaggagctggctttatgacctttacttgagtatttttttgtgtgtgacagttgaacaattctgacccctattattgttggctggacaggcattttctttttaattcctctatgcaaggaactgtggattgcttttttctggatagctagaacgaggccattttctttcaaaagacagtcctagagtttccagtggttttctttaattgtgtatgcgtgagtgtgacagtgtgtgtgcctgtgtctctatctgtgcatgcatctgtatgcacagtttcttagttgtggacaatgcaacttggaatcattttagttttccaattgattttaaaagtttatctatagaagatgagacaaatttgctgtagaagttaccactacttggtcaaaatagagagttgtgggtttttttttttgtttgacaacaatcaaaagtatggcctacagatagtaagggttaaccacccagatttttgtcagataatatatacatgtccatgtaattaaaagtcttcatttgacaaatttatatggtaaatgagcataaaatgaatatcttttcagtattagaacatttctgtttatgccctattccagtggtatttgtggtcgctaggggttgctgggttatccaagtgattcagcatgccttcagaattggcatcctcgggtgattgtccatagcctcttgcaatggtgcctcatcttggggaggctttagaacacagctctcatttagcttattattgatttttttttcttgttttgcagttgttggctagagaaaagtgtgtagcaataagtacgcacacttactgtggtttaccatcatgaccatggatagcaaactgcctttttttttttttttaactcctgtgtcatctctgatgttgtggctaattttaagactttgatttttcagctaggattagcggagaatgacctacctacttgattaatgatgtctgcatgggcttactaagagggtgtggggaatggtggcaggggtaactatcatcgagaatatagggcaatgggtatattctaactttgcataactttgctagattatatatatctttactcacaataagcaaagttgaacaacttaaaattgattccctgttttctgttttcactatccaactaggatgaactcttaagttcatacatatactttaaaatgggaacaaacatagcctgtcatgtctttatttaggctaagtgcatatgtatgtataagtaatgtgtatatccttcacttattaatagtgccttcatgaattcaaagacccttgtcacatggtgctcaggaaaaaaaaagtgccaatattctttttttttttttctctaagaagtactagtttaggtaagtgaaattcaatagcatatcagtgctttaccttagtcactttttgtgttttgatcacccttagtcatcactggagagaagagtttgaattcatttgtggttttgctttagtggcaaacctccttacagggatgagttgccctccattctccttgccatatttggttaatctaggccatgacctttgaggggaaaaggcacagattgcaacttttctttcctgcttttgtgaatcaggccatgttcacgcagggtccttgaaggtgacttgagtgaggaagctatataccgatgacttaccaatttttggtcttataacattctctctctttttttttttttttttttgtagcatatggcttcctctactgtatgttggcatttgccacttttggggatttgactcctgcaggtatttttttttttttcttttgggggagtgtgacggcagtggatatagtcttagatgatgtttttaatagttcaagtccattagtgtcttactctagagaaaacgaaagactcactgtgtgagttttcttgccctctggttttcagaattctgtgtagtttctcaacatttcctttctacctgtcctgaagagctcttatggaaatcatggttgaatgttagtaaatttctaagagctttccaatgttgtctataattagccaaaaaaagacatatgaacttttctcattctgtctacctttttaaaattttattcactttatctttttctccagttttgatagatgattatagagttccccaaaatggccttcttactatttctatattaggtatattatttcagaaaagaaaataatcacttgggaatggcggtgagttcagggggtctgttaaccatttaatttaggattgtttatacatttatttacctcttttaaaaaatttcttcagttaatattcattgaccactcactaagtgttatgttgctagtatttatctttgctttctaattatttttttgtaatttttttgctttctaattcttgagtgaatttaaaactcactgctttattatttaatatcttagatacaatgactatcttaattataattggctttccaaaattttcactttttttcagttaactagttgaatagtatttatcattcacatttgcaccctaactattgttttaacctaaacataaataagcaagcattagaaagtagcataattgctgttaaaatagtcttttctttgcgtgtttaaatattgttagaaacataagcacatgaatttttttggccttttaaatgtctttattgtagctagttataagatgtatatatagcttatatatgtgtatatacacatacatatatatatatacatacatatatatacataaaatgattcttgcaaaagtagttatgggtatttaagtgaaaaatttgtaagtttagaagttaagaaattggaaataatggaattggtttaaaaagctagtctctaaattaacttagaaacctaatagcaaatacagattttgattgctataactaaacactttaattttgaaaaagtttcagaatagaatttctattcccaggggaaaataaacttcatttaaaaatatatgtatacttattttgtgagtatttttttcttttccaaattccaaaaggtgtatactctatatttttgtcataaaaattctgcttgtcgaaaatattgtagtaattttataaattcaataaaacctgagtgatgtga

SEQ ID NO: 166490 - DNA, 552 bp, Homo sapiens
  Payload ID: 12784
  Gene Symbol: PLEKHA3
  Gene Name: pleckstrin homology domain containing, family A (phosphoinositide binding specific) member 3
  ENST ID: ENST00000421187
  CDS Start-End: 1-345
gatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagataatgtgggtggagaaatgaaggaaagaaaccgggaaggggaagggagaaagaaactttcttgggccaatcaagcaagacctggaagagaagaggaggagaggaggagggttaaagaggttgagtatgtgaaaaaagttatctgaggcaggacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttataggga

SEQ ID NO: 166491 - DNA, 749 bp, Homo sapiens
  Payload ID: 12784
  Gene Symbol: PLEKHA3
  Gene Name: pleckstrin homology domain containing, family A (phosphoinositide binding specific) member 3
  ENST ID: ENST00000453653
  CDS Start-End: 138-323
gcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaaggtgacaactttggaggggaccacccttgattggatgcataaattctgttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgc

SEQ ID NO: 166492 - DNA, 3088 bp, Homo sapiens
  Payload ID: 12785
  Gene Symbol: PLEKHA4
  Gene Name: pleckstrin homology domain containing, family A (phosphoinositide binding specific) member 4
  Uniprot ID: Q9H4M7
  ENST ID: ENST00000263265
  CDS Start-End: 557-2896
aggcagggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaactttta

SEQ ID NO: 166493 - DNA, 2614 bp, Homo sapiens
  Payload ID: 12785
  Gene Symbol: PLEKHA4
  Gene Name: pleckstrin homology domain containing, family A (phosphoinositide binding specific) member 4
  Uniprot ID: Q9H4M7
  ENST ID: ENST00000355496
  CDS Start-End: 379-2130
gagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacagccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaactttta

SEQ ID NO: 166494 - DNA, 525 bp, Homo sapiens
  Payload ID: 12785
  Gene Symbol: PLEKHA4
  Gene Name: pleckstrin homology domain containing, family A (phosphoinositide binding specific) member 4
  ENST ID: ENST00000596982
  CDS Start-End: 1-79
gctcaggagggatcccaaccttcccgtgcacatccgaggctggcttcataagcagacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctc

SEQ ID NO: 166495 - DNA, 766 bp, Homo sapiens
  Payload ID: 12785
  Gene Symbol: PLEKHA4
  Gene Name: pleckstrin homology domain containing, family A (phosphoinositide binding specific) member 4
  ENST ID: ENST00000595867
  CDS Start-End: 590-766
cttgagtgtgtgtgacttgctggggctcccgtgggggtcacagcctgtcggggagaagactggaggggaagatgccacaaagcggacattactgaggatttggacagtagaggaggattctaacccagtgggacagtaagacacagtgaagtgagacatgtccttgaggctgacttgatggccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcct

SEQ ID NO: 166496 - DNA, 602 bp, Homo sapiens
  Payload ID: 12785
  Gene Symbol: PLEKHA4
  Gene Name: pleckstrin homology domain containing, family A (phosphoinositide binding specific) member 4
  ENST ID: ENST00000594100
  CDS Start-End: 1-602
gcctgagcctggccagcagcgcctccaccatctcctcgctcagcagcctgagccccaaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctc

SEQ ID NO: 166497 - DNA, 829 bp, Homo sapiens
  Payload ID: 12785
  Gene Symbol: PLEKHA4
  Gene Name: pleckstrin homology domain containing, family A (phosphoinositide binding specific) member 4
  ENST ID: ENST00000597129
  CDS Start-End: 1-358
tggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaa

SEQ ID NO: 166498 - DNA, 616 bp, Homo sapiens
  Payload ID: 12785
  Gene Symbol: PLEKHA4
  Gene Name: pleckstrin homology domain containing, family A (phosphoinositide binding specific) member 4
  ENST ID: ENST00000594195
  CDS Start-End: 237-616
tgtgtgacttgctggggctcccgtgggggtcacagcctgtcggggagaagactggaggggaagatgccacaaagcggacattactgaggatttggacagtagaggaggattctaacccagtgggacagtaagacacagtgaagtgagacatgtccttgaggctgacttgatgggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttgg

SEQ ID NO: 166499 - DNA, 2293 bp, Homo sapiens
  Payload ID: 12786
  Gene Symbol: PLEKHA8
  Gene Name: pleckstrin homology domain containing, family A (phosphoinositide binding specific) member 8
  Uniprot ID: Q96JA3
  ENST ID: ENST00000258679
  CDS Start-End: 402-1724
cctgggcatgcgcgagcgcgtcccgggcccggcgagtcgagggttcaggtggtgcgccgtggcgccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaagaaatccaacagaaaacacttgacaccaaaacataccctgatgaagatcctgaacttcaagaatgaagaaagaattcctcaccattcaggcagaaaaagcaagtcaccaagggacctcaaacttcctttccacaagattctgtgacgggaaacaatgggggagtatttccgaagttctgagtaggaaaaaagaatgactcaaatgtattattgccaaccaagtcgtcaaatctaatgtcaagttctcttaagcaggtaagaactcagaacataatacctgagtgccttcttaaggaaaccatttgataggaaagatgaaccaaataactcaatgatggatgagctggtagaaaaaaagctggtggtgaaccaaggtcaaactggaaattatagtcacagtatagatatagattataaatattacaaaccctaagatagctaataaattgggaatgggagaagggaggatataagagcactaatgccctcttattttcatagcagagacttgatactgtctcaacttttttcaaaaacacaatttcttaaattttttggtaatcttttaaataaacagatttctaaaaagaaa

SEQ ID NO: 166500 - DNA, 1907 bp, Homo sapiens
  Payload ID: 12786
  Gene Symbol: PLEKHA8
  Gene Name: pleckstrin homology domain containing, family A (phosphoinositide binding specific) member 8
  Uniprot ID: Q96JA3
  ENST ID: ENST00000396257
  CDS Start-End: 339-1706
gccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcggtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtca

SEQ ID NO: 166501 - DNA, 2840 bp, Homo sapiens
  Payload ID: 12786
  Gene Symbol: PLEKHA8
  Gene Name: pleckstrin homology domain containing, family A (phosphoinositide binding specific) member 8
  ENST ID: ENST00000396259
  CDS Start-End: 323-1642
agctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaagtgtaggaatgtgggtgtagacggaactccagaaaccatcatggaccatgaggcaactctgaggatggaagccacacactaaggacggtaaagcagaaagaagagctgaaaccctgatgataaagaagcagccaattccgtcctgcactgcccacctccagatctcattcatgtgaaacaaagagaaactttatcttgttcaagtcactttagtcaagatttttattatcagatgaatgcaatttctaattgatacaccttaaaattttcaacatgtacacctgatttaacaaaatctagaattaagtcaatacttctacatgcattatagaccaaaggtcactgctataagaactttgggtatatagtcaaattcctcacatttttagaaacttgtttattcattgcatccctcccccatctcactctctcacacactcacatatttattttctcagatccttataagttcataagacatatgtccttattccatttttacagatgagaaaactggggtttgcaggggttaagtaacttatccaagatcacacaattaattagtggcgaagtcataatttgaagtctttctaatgcccaaatgtttccattgtgtcacatatcggagctgtgctctttccatcagccagtttcccattatcatagctgatgacatgcacacccaccatctggggcaggctttagtacagcactctgtgccatcatccagatcaccaaatcttagtaaatggacgtgtcataagagataaggctgccatagaatcacagcagcttctggcttagtaaattacctggatacacaccttttcctagaggaaatcccacatcttcgtaggagatctggtgtaatgctcttgggacctctctctagaggatgagctagtatcactgggtcctagtaagtttcagcaaatataatagagacagaactgtcatcattatcagaaaagaaacagagaaaaatgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaagggggaatcattgaagaagacagaatattgaagtgttcaaatgaataaagaagctaaaaactaaa

SEQ ID NO: 166502 - DNA, 7835 bp, Homo sapiens
  Payload ID: 12786
  Gene Symbol: PLEKHA8
  Gene Name: pleckstrin homology domain containing, family A (phosphoinositide binding specific) member 8
  Uniprot ID: Q96JA3
  ENST ID: ENST00000449726
  CDS Start-End: 403-1962
ccctgggcatgcgcgagcgcgtcccgggcccggcgagtcgagggttcaggtggtgcgccgtggcgccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgttagctttaagggcagctccatcctatgaagattttgtggccgcgttaaccgtaaaggaaggtgaccaccagaaagaagctttcagtattgggatgcagagggacctcagcctttacctccctgccatggagaagcagctggccatactggacactttatatgaggtccacgggctggaatctgatgaggtggtatgatggctgctgggcagcacctcctaacttcagggaataagtgctaaagtgttttgttgccctacttaatttccagcaacagcctcaaccctctccaaccccttcacctggggggatggacaggaggtggcaaaacccagtgcttttataatttttaaaatgcatatgtgttttgtttaaagatcaaggtgctatatatttcagttcagcaggcctactggaaaccaaatgataagctgctgtagacttgaacagcaagttataagagcagatttaacaaacaaatttgctgttattgtgtattgtattgtttttatattttagtctaatgggccacccaaacccaagctgaaaatcagcaaattccatattaagtaccataattcatagccagtgtttcagccaacttagactagacatttggaggtagtataagctgctttgttgaagctgtgtagagtttgctgttcctagatgttcttcagtggaccctcttcactgcaactctgtcagtgataagggcctgtgtagtaaagatgttcagggcattcacatgaccatgcaattgtgggaggcgaagaagacgtggacaggagtcccatccttgctgacaggcatgaaaccgttgctctgagaagattaatggtgtgccctagccccaagttggaggggagaatatgagagaggtgggacaggtcatttgagatgacacctcccaactgcctaccatttaccagcatgttccccatgcattatctcaattggacatcacaagtaatgatacccagagggattattactccacttcaaaagcaaggtttagaagttgagggatctgttcacagtcacatagtttttaagcagaggagccagataatttccaagtgtgacctggactgcctctgcatcaaagtcatatggagtgcttgttcaaacagcagattcccaggccttattttggcctaaagaaccagagtctaggtggtgggacataggaatctgcatttcagtaaactttacacgtgattcttctgcacacagtattgaagagcaactagattaaattctagtttacaaaattaccagttttcttcaagaactaaatgatatgtcctttttttttttttcaaagaggataaggctgctatttaaataaaatagctaaatggagagtgagaagtggagcaggttcattcagcagcattcttaattgagccagcattgacacccagccagcaggcctttgcattgcattcggggaccatgactctgaatctgcttaccaatcaatctcggtttaatcaccaaaagtgcagagcaggcaaaatgcagctgtttatcaatctcaaaagctttgggacagtgtcatagttgaaagatgagacttaagaaaacagtttcttaaacttcttaaaacttaagaaacattgtttcataaaacaatattgagtgggcattcttctgcacagtgtgatgctccaaccctggccctagtctcagtagaccatgctgcctcgagtgtgcatcggagagaagccatgggtaccttccccattagaggctacttccttctagtaacaggaagggaagttccagcatgaggtagttatccagggtagaaggtcctttgaggggcttggttgaattgagagcatcatctctagatgatgctgttcctgctgcagatctctaggatggagagaattctctctttagtcagagaagtttatgtagggaggggtattggttttgcctttgtgtgtctttaaacaaatgaacatttatttagctcagattaattaggtattttgcccacataaagacttctggaaaatacttaaacttgaaaaatcaacatcacatgttttaaagctagggagaaagaaggggggtattaaaatgatgttgattattttgtattttgccaaggtgtgtgtgtgttatttccctcccactctcatgagcagtgagtatagatctccttctctgattagtatgaatatgatggcaggactcggggatagtccctgcccttgacatagccccctaaaacggaaaaagaaaaagccagtttttgcttgtactttgaatgaagatgttttaggcattgtaccatttagcggggatgataccaggtggttgttagaattgtgcagtgtgatcattctaaacagctgctggtgctccctgtcacctcaggtgaactctgtggtctcttggagaggtagcactctgaaaatacctcaggtttgccaccgcaactctgaatacacacaaaaggaaagctgctcagcatggccattttgcatttgtataggtagtgactagatgtacacaacttaatttgctgggaatgaggggcttaatattatctgagatcattgagaacccagatcagacagaatagcttgaataagttacattttccaattaccctttttccacatctgtagaaagagggtaatattttttaataggtattttccccactggagcatattacgtttgcctaagatgtataaaagtttgtttaagatgtgtaaaagtttgcttaaggaactgaggatccttaaataaaaatattagaaattagaaattgaacctaatactaaacagtaaattcagcttaacctgaaccttggcatagtcagagcttcctcctacatctaaagtatttgctctctgttttagttaaagtcataatttgcgctgatgtgtaatcactttccaagaagagggcaatgagaaaagatatttaaagctttctctccatagccctccaagacttctgggacaactaaatttactttcaccattactgtgagaggaggtgagaaaactctagtattttgttggcagagtaatcactttgttctcatcgctcaaagcatttttaggattatttttctagcgtaacctttagagagaactggaagaaaaaggaaattggtctactaggtattgtagacacaaataagtaacattaggctaaccccttatgagacatttccacacaatttcatcgtgcctgtacttttctctatggtaaaagccagtgtttacactttgtagggatcagggtgtatttgttgaattaaacaaaatattttcaatgatggcaagtctcttgacttttgaaagcaagtcagattccttatagctaatgctggtgaaaaatgttaaattggagagatcccttttgggagtgaaaccaaattgtaactatgaggagaagatggtcttctcattggctcttgatgtagctctgaagggagttccagaagaggagctctcacagaatgttgagcctgtgggcccaagacattgacttcgaagggtagttctcattaggatgtataagtagtggcttgaggcaccttcttatcattttttgcatgttattctgattattaaacttcccccaatgtcatattccatgatgagggatttctgaactccatagtccagcgttgttgcttttctctcttctttgctactgaaaattgccagcagtaccgccatcagcacaccaaatctacccccacttatgtttgttctgccccatttcccaggagcagcttctagcacatatgtagagtatctggcaccaccttagcccagggctgcgtgcctgatcagtggggattctgttcccccaccccccagactgcaagagcttcttaagaaggagcccatattcccatttgtagctggaaagcgggtgaatgacatgacatggggcacctaggaaagatgattattagaggagtgcagcggaaaaaaatttgcactcttctccttttggttattactttccaaatatattaacaaaaagttgatgcttttaactttatattttcagaaaagtgtttttaattaaaaatatgtgatagggaccaaataagtaaagtacatttttctccactaaatttgaagtgagggaaagaggagccaaagtaagagatttttttttaaggaaacttaatctgattgtgaaaatcatacatatggagaaacatcagatcaggcaatagagtcagagggtcatgagcaatagacgatgatgcgaggcatttggggagcttcctggaggaaaattaagtttttttcctagcaaactaccatgtcctacaagaacttggttatataatggtgcgtctctgaatcactgattaaaaccagttgcttctgattttagtcacaggttttacaagtattcagctctccctcatgtttcatttctttttttaagataatctatcaaccttttttaaattttaaaatttttagatgtagagtttataagtaaaatatatttttagccattgttctgttagctgagctgatgtgtttggtcttagagggcctgacttcagatactctttgtgatcttgtaagggctctacacaaacttcattatgtatggtaaatttgtattcttatggattgtatatagaatgctttcgttagaagtacattctacttctgtatgtccctttgtaatccgcagttgcttactcaggggtttcatagtcatttcataaaaaataattcactagctgtctaatggtattttaagactgtttatctgtatcacaacgtcattaggagttctttcaacaattccataaatatactgtttactagaccttccctgtaaatgttcccaattcccatcctgtctcagacagtcaatagtcctgtgtacagtgactatttgcatgatttctcattgcactgctgcattcaggcactccagggcatgattaaacagtcattaacagtgcctctctggtacagttgatgcatgcattgatctttcttctctgctgtttttatatagcctttaattaaaaggaaaaaaataccactactctgcaatgcaaaagtcttcaaaattctttgtttcctgtattaatcacttctgttccagagtgaacaaatgttttcagctaagctatgtgagaatgtaagaataatatcctgcttgttctaaatagttcatatatttaaagtgtggtcagtatttcctccctgtaccttacaaacagaaaccaccctgggatggttgataccccttacaaagtcgatcttacccacacagactcctgtgtatgcgtgtctgtttataggtgtatatggagtcagtgttgataggaaggatgctctagaagtacttctgttgtttcctagaaggctatgagccagttccatggcatgtttaatgtataattcccatgtatcatgagaatttcactagaatgtcattaaacagcccaactacctcatgtgaaattggctgtggacaatctgtgtcagatgagaaatgtgttcagataaatttaatctggttaatagacttaacaaattaatgtctacataaagaagaaacatgatagaccagatgccaaaggctaaaatgtacatagatttccttggattaatttttaagtcactgtttaattccatgcctagtattcttatgaatgtttgtggtttcatagatttatgcactttgaatatctgtcacgtgcagtgttaatgttacctgttcttgtctctcagcattttgaatgagcatcataatcagagtagaaggcaagttaaactataaaagtgtcaagtggcttgttaacttcttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagtattaagttctt

SEQ ID NO: 166503 - DNA, 7514 bp, Homo sapiens
  Payload ID: 12786
  Gene Symbol: PLEKHA8
  Gene Name: pleckstrin homology domain containing, family A (phosphoinositide binding specific) member 8
  ENST ID: ENST00000440706
  CDS Start-End: 1-1638
gctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgttagctttaagggcagctccatcctatgaagattttgtggccgcgttaaccgtaaaggaaggtgaccaccagaaagaagctttcagtattgggatgcagagggacctcagcctttacctccctgccatggagaagcagctggccatactggacactttatatgaggtccacgggctggaatctgatgaggtggtatgatggctgctgggcagcacctcctaacttcagggaataagtgctaaagtgttttgttgccctacttaatttccagcaacagcctcaaccctctccaaccccttcacctggggggatggacaggaggtggcaaaacccagtgcttttataatttttaaaatgcatatgtgttttgtttaaagatcaaggtgctatatatttcagttcagcaggcctactggaaaccaaatgataagctgctgtagacttgaacagcaagttataagagcagatttaacaaacaaatttgctgttattgtgtattgtattgtttttatattttagtctaatgggccacccaaacccaagctgaaaatcagcaaattccatattaagtaccataattcatagccagtgtttcagccaacttagactagacatttggaggtagtataagctgctttgttgaagctgtgtagagtttgctgttcctagatgttcttcagtggaccctcttcactgcaactctgtcagtgataagggcctgtgtagtaaagatgttcagggcattcacatgaccatgcaattgtgggaggcgaagaagacgtggacaggagtcccatccttgctgacaggcatgaaaccgttgctctgagaagattaatggtgtgccctagccccaagttggaggggagaatatgagagaggtgggacaggtcatttgagatgacacctcccaactgcctaccatttaccagcatgttccccatgcattatctcaattggacatcacaagtaatgatacccagagggattattactccacttcaaaagcaaggtttagaagttgagggatctgttcacagtcacatagtttttaagcagaggagccagataatttccaagtgtgacctggactgcctctgcatcaaagtcatatggagtgcttgttcaaacagcagattcccaggccttattttggcctaaagaaccagagtctaggtggtgggacataggaatctgcatttcagtaaactttacacgtgattcttctgcacacagtattgaagagcaactagattaaattctagtttacaaaattaccagttttcttcaagaactaaatgatatgtcctttttttttttttcaaagaggataaggctgctatttaaataaaatagctaaatggagagtgagaagtggagcaggttcattcagcagcattcttaattgagccagcattgacacccagccagcaggcctttgcattgcattcggggaccatgactctgaatctgcttaccaatcaatctcggtttaatcaccaaaagtgcagagcaggcaaaatgcagctgtttatcaatctcaaaagctttgggacagtgtcatagttgaaagatgagacttaagaaaacagtttcttaaacttcttaaaacttaagaaacattgtttcataaaacaatattgagtgggcattcttctgcacagtgtgatgctccaaccctggccctagtctcagtagaccatgctgcctcgagtgtgcatcggagagaagccatgggtaccttccccattagaggctacttccttctagtaacaggaagggaagttccagcatgaggtagttatccagggtagaaggtcctttgaggggcttggttgaattgagagcatcatctctagatgatgctgttcctgctgcagatctctaggatggagagaattctctctttagtcagagaagtttatgtagggaggggtattggttttgcctttgtgtgtctttaaacaaatgaacatttatttagctcagattaattaggtattttgcccacataaagacttctggaaaatacttaaacttgaaaaatcaacatcacatgttttaaagctagggagaaagaaggggggtattaaaatgatgttgattattttgtattttgccaaggtgtgtgtgtgttatttccctcccactctcatgagcagtgagtatagatctccttctctgattagtatgaatatgatggcaggactcggggatagtccctgcccttgacatagccccctaaaacggaaaaagaaaaagccagtttttgcttgtactttgaatgaagatgttttaggcattgtaccatttagcggggatgataccaggtggttgttagaattgtgcagtgtgatcattctaaacagctgctggtgctccctgtcacctcaggtgaactctgtggtctcttggagaggtagcactctgaaaatacctcaggtttgccaccgcaactctgaatacacacaaaaggaaagctgctcagcatggccattttgcatttgtataggtagtgactagatgtacacaacttaatttgctgggaatgaggggcttaatattatctgagatcattgagaacccagatcagacagaatagcttgaataagttacattttccaattaccctttttccacatctgtagaaagagggtaatattttttaataggtattttccccactggagcatattacgtttgcctaagatgtataaaagtttgtttaagatgtgtaaaagtttgcttaaggaactgaggatccttaaataaaaatattagaaattagaaattgaacctaatactaaacagtaaattcagcttaacctgaaccttggcatagtcagagcttcctcctacatctaaagtatttgctctctgttttagttaaagtcataatttgcgctgatgtgtaatcactttccaagaagagggcaatgagaaaagatatttaaagctttctctccatagccctccaagacttctgggacaactaaatttactttcaccattactgtgagaggaggtgagaaaactctagtattttgttggcagagtaatcactttgttctcatcgctcaaagcatttttaggattatttttctagcgtaacctttagagagaactggaagaaaaaggaaattggtctactaggtattgtagacacaaataagtaacattaggctaaccccttatgagacatttccacacaatttcatcgtgcctgtacttttctctatggtaaaagccagtgtttacactttgtagggatcagggtgtatttgttgaattaaacaaaatattttcaatgatggcaagtctcttgacttttgaaagcaagtcagattccttatagctaatgctggtgaaaaatgttaaattggagagatcccttttgggagtgaaaccaaattgtaactatgaggagaagatggtcttctcattggctcttgatgtagctctgaagggagttccagaagaggagctctcacagaatgttgagcctgtgggcccaagacattgacttcgaagggtagttctcattaggatgtataagtagtggcttgaggcaccttcttatcattttttgcatgttattctgattattaaacttcccccaatgtcatattccatgatgagggatttctgaactccatagtccagcgttgttgcttttctctcttctttgctactgaaaattgccagcagtaccgccatcagcacaccaaatctacccccacttatgtttgttctgccccatttcccaggagcagcttctagcacatatgtagagtatctggcaccaccttagcccagggctgcgtgcctgatcagtggggattctgttcccccaccccccagactgcaagagcttcttaagaaggagcccatattcccatttgtagctggaaagcgggtgaatgacatgacatggggcacctaggaaagatgattattagaggagtgcagcggaaaaaaatttgcactcttctccttttggttattactttccaaatatattaacaaaaagttgatgcttttaactttatattttcagaaaagtgtttttaattaaaaatatgtgatagggaccaaataagtaaagtacatttttctccactaaatttgaagtgagggaaagaggagccaaagtaagagatttttttttaaggaaacttaatctgattgtgaaaatcatacatatggagaaacatcagatcaggcaatagagtcagagggtcatgagcaatagacgatgatgcgaggcatttggggagcttcctggaggaaaattaagtttttttcctagcaaactaccatgtcctacaagaacttggttatataatggtgcgtctctgaatcactgattaaaaccagttgcttctgattttagtcacaggttttacaagtattcagctctccctcatgtttcatttctttttttaagataatctatcaaccttttttaaattttaaaatttttagatgtagagtttataagtaaaatatatttttagccattgttctgttagctgagctgatgtgtttggtcttagagggcctgacttcagatactctttgtgatcttgtaagggctctacacaaacttcattatgtatggtaaatttgtattcttatggattgtatatagaatgctttcgttagaagtacattctacttctgtatgtccctttgtaatccgcagttgcttactcaggggtttcatagtcatttcataaaaaataattcactagctgtctaatggtattttaagactgtttatctgtatcacaacgtcattaggagttctttcaacaattccataaatatactgtttactagaccttccctgtaaatgttcccaattcccatcctgtctcagacagtcaatagtcctgtgtacagtgactatttgcatgatttctcattgcactgctgcattcaggcactccagggcatgattaaacagtcattaacagtgcctctctggtacagttgatgcatgcattgatctttcttctctgctgtttttatatagcctttaattaaaaggaaaaaaataccactactctgcaatgcaaaagtcttcaaaattctttgtttcctgtattaatcacttctgttccagagtgaacaaatgttttcagctaagctatgtgagaatgtaagaataatatcctgcttgttctaaatagttcatatatttaaagtgtggtcagtatttcctccctgtaccttacaaacagaaaccaccctgggatggttgataccccttacaaagtcgatcttacccacacagactcctgtgtatgcgtgtctgtttataggtgtatatggagtcagtgttgataggaaggatgctctagaagtacttctgttgtttcctagaaggctatgagccagttccatggcatgtttaatgtataattcccatgtatcatgagaatttcactagaatgtcattaaacagcccaactacctcatgtgaaattggctgtggacaatctgtgtcagatgagaaatgtgttcagataaatttaatctggttaatagacttaacaaattaatgtctacataaagaagaaacatgatagaccagatgccaaaggctaaaatgtacatagatttccttggattaatttttaagtcactgtttaattccatgcctagtattcttatgaatgtttgtggtttcatagatttatgcactttgaatatctgtcacgtgcagtgttaatgttacctgttcttgtctctcagcattttgaatgagcatcataatcagagtagaaggcaagttaaactataaaagtgtcaagtggcttgttaacttcttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagtattaagttcttaaa

SEQ ID NO: 166504 - DNA, 2140 bp, Homo sapiens
  Payload ID: 12786
  Gene Symbol: PLEKHA8
  Gene Name: pleckstrin homology domain containing, family A (phosphoinositide binding specific) member 8
  ENST ID: ENST00000622102
  CDS Start-End: 403-1782
ccctgggcatgcgcgagcgcgtcccgggcccggcgagtcgagggttcaggtggtgcgccgtggcgccgcctgcgaccggcagctcgttcgccgcactttggaggcttcggctgcccctccgacccacgtagggcccggacccgggcctccttgtgaacagcgtgccggcttcgccccacgggttcaccggctggctgggcttcaagcgccgaggccgccgcagtgaccccgcccccgggccgaggatgtgaggcgggccgggcgtccccacaccgggcccgggcgccgggagtgggcgtctgggcagcgccaggcgatggccctgctgctggtgctcctcgcctcttggggcctggggcagtgagggggccggcgggcgtgggccgagtggccgcgggcgccatggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgggacacacaaatgtctgatggtggcccaggagggctgtcactcagaatcaggcgggtgcagagtggcctgcaggacatgatgacccagcatgagacaggatgcatcacatctgggtgacgcctctctccaggggatcagcctggactaaatgcctctcctgggccaggatgcccagcaagccccgagatgcctcctggagagaaggaagtatgtgagagtatcctgagttaagtgagatctaaaatgcctgagaaaaccctgaaatgactgagtctatctggaacttatttgattgtttttctgccatcagatagaatgaggtctcaaaagagaaattaaattatattacaagaaaataaagctcaattgcttgcc

SEQ ID NO: 166505 - DNA, 4238 bp, Homo sapiens
  Payload ID: 12787
  Gene Symbol: PLEKHA5
  Gene Name: pleckstrin homology domain containing, family A member 5
  Uniprot ID: Q9HAU0
  ENST ID: ENST00000299275
  CDS Start-End: 7-3357
tcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 166506 - DNA, 4391 bp, Homo sapiens
  Payload ID: 12787
  Gene Symbol: PLEKHA5
  Gene Name: pleckstrin homology domain containing, family A member 5
  Uniprot ID: Q9HAU0
  ENST ID: ENST00000424268
  CDS Start-End: 217-3513
aaaagagatcacggtgtgcccctttgtcatcgttctgtcaggaagcatgtaatttgtctttagaaaccagaagcctgagacaaagaaaagaacacagatttttagcaaaaggctatttgccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgatgaaagaaaatgaacctattatcaccatggttcacacaatgattgagaactcggcgctaagaccccaactgtaccagcaactgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 166507 - DNA, 4762 bp, Homo sapiens
  Payload ID: 12787
  Gene Symbol: PLEKHA5
  Gene Name: pleckstrin homology domain containing, family A member 5
  Uniprot ID: Q9HAU0
  ENST ID: ENST00000429027
  CDS Start-End: 33-3881
gagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagaattacctttaatttccgagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagatgaaagaaaatgaacctattatcaccatggttcacacaatgattgagaactcggcgctaagaccccaactgtaccagcaattcttaagacagaagagcaagataagtctatattgtctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 166508 - DNA, 1954 bp, Homo sapiens
  Payload ID: 12787
  Gene Symbol: PLEKHA5
  Gene Name: pleckstrin homology domain containing, family A member 5
  Uniprot ID: Q9HAU0
  ENST ID: ENST00000540972
  CDS Start-End: 49-279
gccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaactgaatagatttccttttcattcttcctgggaatagaagatgtaatggaagttccagtatctgtatgcaggcctatgactagcttcacttcttggtgactaatactagttgacaaaacagcatattctaaactgattgtcttcgttatccagtagctttcctattctccataacaaatgttccaaatctttgattactcacctcagaatgcttgtctcactcctcttttcctcattcctagtagatcataccttggagaagaaagtagaaactatcaggcctgaacttcattagctttttcttcctcttcaatccaaatctgtctgtatcttcattcatttttcttaaccctttccttgcttgctatttctgctttccaaaaccaaggaaggaattttgacagaggtacccaaggaattcactgggggaaaatgaatgattcaataaatgatgttatgataattagatagatagctatatgtaagcataaaaaatttttaaaaccttaggcccttattatcatatcatgcacaaaaattaagtggattattgatttaaatgtaaaaacaaaaagtataaaacttttagaaaaaagagattatttgtgacattgggtctggcaaagatttcttagatgcgattaaagatttacaaaagaaaaaattgataaattagacttcatcaaaatttagaaattttgctttatctgtgtaggatactgaagagaatgaaaagacaagtcacagactgggagaaagtacaggcaaatcacatatttgtcaaataactcatatccagaatttttaaagaacttttacaactcaataataacaagacaaacagctcaattttttaaatgagggaaaaatttaaatatatttcacatgagaatatactcaaatagccagtgagcacatgaaaagatgttcagcatcattagacattagcaaattgcaaattaaaaccacactgaggaacccactaggaatggctataatcaaagacgatcagtatcaagtattgcggagaatgtggagaaactcaaactctgttacactagtaatagaaatataaaatgttagaaccactttggaaagagattggcagtttctggaaaaaattaattgtaaatttgaccaagcaattttactacgtaagtatgttaagaatgaaaacgtgtgcacacaaagatctgtactaaaatgttgatagcattattcataacagcctaacagtgcaaatgtctgtcaactactgtgaatggagagacaaaatgtgtttattaatacaataaaactacccagcaataaaaagaaataattgactgataaatggtatacgatgactgaactttaaaaccttgatgctgcctaaaagagccagacacagactacacattgtataattccatttttatgaatttcccagaaaggcaaattatagagacaaaacaaatcagtggttgcctagggctggtggtggacgtggagattgactgtaaatgggacatgagggaatttttttgtggtgatagaaatgttataaaactagatgtggtaatagttgcacaactctgtaaattcactaaaagtcactgaactgtacacttaaccataggtgggtttaatgaaatgtgaattacactgcaataaaactaaataaaagctgagttagtacca

SEQ ID NO: 166509 - DNA, 6487 bp, Homo sapiens
  Payload ID: 12787
  Gene Symbol: PLEKHA5
  Gene Name: pleckstrin homology domain containing, family A member 5
  Uniprot ID: Q9HAU0
  ENST ID: ENST00000538714
  CDS Start-End: 5-3529
agacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaaagatgtcccccatgctggagtgtagtggcataatcacagctcactgcagccttgacctcctgggctcaagcagtcgtcctgcctcagcctcacaagtagctgggatcacaagtgcacgccaccacactcggctgatatttcgattttcttatagagacagtcttactaagttgtccacgctggtctcaaactcctgaattcaagctaccctcccactgcatgagccactgtgcctagcctctttgattttcacattctcaaaatatttcttttattttctctcctttttttttttttttcgaggcaaggtcttactctgtcacccaggctggagtgcagtggtgcaagatcatggctcaatggctcactgaaggctgacctcccaggctcaagcaatcctcccacctcagccccctgagtagctgggactacaggtgtatgccaccatgccaggctaattgttttgcagagatggagttttcaccatgttgcccaggctgatctcaagctcctgagctcaagtgatctgtccgcctcagcctcccaaagtgctgagattacaggtgtgagccaccacacccagccttttttcttccttttcaagcattttttaaatttcactagctttgggtacaagtggttttgggttacatggaagaattgtatagtggtgaagtctgagattttagtgcacccattacccgagtagtgtatgttgtacccaatccttcaccgaccttccaccctctcccttctgagtctccaaagtccattataccacactgtatgcctttgcatacccatagtgtagctccaacttataagtgagaacatatgatatttggttttcctttcctgagttactttacttagaataatggcctccagctccatccaagttgctgcaaaatacattattttgttcctttttattgctgagtagtattccatggtgtatataaaccacattttctttatccactccttggttggtggactcttaggttggttccatacccttggagttgcaaattgtgctgctataaacatgcatgtgcatgtatcttttttatgtaatgacttgttttcttttgggtcgatactcagtagtgggattgctggatcaaatgctggatctacttttagttctttaaggaatctccacactgttttccgtagtggttgtactagtttacattcccaccagcagtgtaaaagtgttttcttctcaccacatccataccaacatctgttgttttttgacttttaaattatggccattctttttttttgtttttgagatggagtctcgctctgtcagcaggctggagtgcagtggcgtgatcttggctcactgcaacctcctcctccagggttcaagtgattctcctgcctcagcctcccccgtagctgggactacaggcgtgtgccaccacacccagctaatttttgaatttttagtagagatggggtttcaccatgttggccagtatggtctcgatctcttgacctcatgatccgcccacctcggcctcccaaagtgctggcgtgacccactgcacccggccaattatggccattcttgcaggaataaggaggcatctcattgttgtgtaccttcttttgagaaatgcctattcgcgtcatttgcccactttttgatgggattatttgtttttgttttttttttcttgctgatttgttttgagttccttccagattctggatattagtcctttgttggatgcatagtttgcaaatatttcctcccatcctgttttctggaatctacttcctttcacaccttattgtaggaactataatctgtgccctttttttcagcccaaagtattttgttgtcttttcatatttgtaacttttatttgagattatgtctacctggaacctcaaagaggcttctgtttttgtcagttggtatctgtgcaggactgaagtgcttgctggagagttacaaataacctaactgtgatagtcttacctgtgttctgcctttgtcacttgtgtttaagccttttttcttttttcttttttcttttttttttttttgttgagaccaggtctcaccctgtcacccacactggagtgcaatggtgagatcttggagccttgccctcctgggcttaagtgatcctcccacgacagcctcccaagtagctgggaccacacgcctgtgccaccaagcctggctgatttttttgtattttttgtagagtaggggtttcaccgtgttgcccaggctggtctcaaactcctgagctcaagcgctctgcccgcctcaatctcccaaagtgctgagattacaagattgagccatcacgcctggctatgtttaaacttttaatttaatatgtttagaaatgactgttgaggccaggtgcggtaatgccagcactttgggaggccagggctggtggatcacttgaggtcgggagttcaggaccagcctggccaacatggtaaaaccccatctctacttaaaaatacaaaaattagctgggcatggtgtcaggcgcctgtaatcccagctacctgggaggctgagacaggagaatcgcttgaacctgggaggcagaggttgcagtgagccgagatcacaccatcgcactccggcctgggtgacagaacaagactttgtctcaaaaaaaaaaaaaaaaatctgggtgtggtggcccacacctgtaatcccagcactttgggaggccgaggcaggcagatcacctggctcctgaccagcgtgaccaacatggagaaacccagtctctactaaaattacaaaattagctgggcgtggtggcacatgcctgtaatcccagctacttgggaggctgaggcaggagaatcgcttgaacccagaggcagtggttgcagtgagccgaggtcgtgccattgcactccagcctgggcaacaagaacgaaactctgtctc

SEQ ID NO: 166510 - DNA, 3139 bp, Homo sapiens
  Payload ID: 12787
  Gene Symbol: PLEKHA5
  Gene Name: pleckstrin homology domain containing, family A member 5
  ENST ID: ENST00000536974
  CDS Start-End: 209-3139
gtgctcactgagaacagctcaaagacaaagcagttgagtcttatttttactccagtgttctttttgcctgtaattgaatatccttttaagaattgattttgatgaaggctgccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggat

SEQ ID NO: 166511 - DNA, 3357 bp, Homo sapiens
  Payload ID: 12787
  Gene Symbol: PLEKHA5
  Gene Name: pleckstrin homology domain containing, family A member 5
  ENST ID: ENST00000539256
  CDS Start-End: 660-3284
tcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaa

SEQ ID NO: 166512 - DNA, 557 bp, Homo sapiens
  Payload ID: 12787
  Gene Symbol: PLEKHA5
  Gene Name: pleckstrin homology domain containing, family A member 5
  ENST ID: ENST00000538677
  CDS Start-End: 1-406
tgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctatgctgtaaactgatgtttgctgtatgctcctcctgatttgaaatagatgaaagaaaatgaacctattatcaccatggttcacacaatgattgagaactcggcgctaagaccccaactgtaccagcaattcttaagacagaagagcaagataagtctatattgtctgtcacaagatgaaggtagaggc

SEQ ID NO: 166513 - DNA, 2072 bp, Homo sapiens
  Payload ID: 12787
  Gene Symbol: PLEKHA5
  Gene Name: pleckstrin homology domain containing, family A member 5
  ENST ID: ENST00000538972
  CDS Start-End: 1-1194
tacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 166514 - DNA, 633 bp, Homo sapiens
  Payload ID: 12787
  Gene Symbol: PLEKHA5
  Gene Name: pleckstrin homology domain containing, family A member 5
  ENST ID: ENST00000538305
  CDS Start-End: 280-633
atatgaagtacttactcttggagactgcggtgtggttcagttttcttatagtggaaagagcagaaaagagatcacggtgtgcccctttgtcatcgttctgtcaggaagcatgtaatttgtctttagaaaccagaagcctgagacaaagaaaagaacacagatttttagcaaaaggctatttgccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctct

SEQ ID NO: 166515 - DNA, 7401 bp, Homo sapiens
  Payload ID: 12788
  Gene Symbol: PLEKHA6
  Gene Name: pleckstrin homology domain containing, family A member 6
  Uniprot ID: Q9Y2H5
  ENST ID: ENST00000272203
  CDS Start-End: 318-3464
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgagggagaagcggaggagcctgcagctcccggccagcccggcccccgaccccagtccccggccagcctacaaagtggtgcgccgccaccgcagcatccatgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctactgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgtgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacgcattcctcctcagctccacccacctggagacgaatgtagccagagaggaggaaggagggaaactgaagacaccgtggcccctcggccttctctctgctagagttgccgctcagaggcttcagcctgacttccagcggtcccaagaacacctactaattcctctgcactccttcatggctgggacagttactggttcatatgcaagtaaagatgacaatttactcaacaaatatttatcgagcaccttttatgtaccaggcactgttgtaggtgcttaggatattctcatgtttctgagggattacagcctgggaggattccaccgatcttcacttctagcaggttttttaaacgtgacccttggctgtatttcccatcttcacagttcaagcaccccaaacctgccctttctcccctgcagactggcaggtgggattggctcccaggtcatttcctctctctctctttctcccaagcctttctccctccacaggaaacagatttttcagggccttccatgcctgccactttgtccgtctctttttttttttttaaagtaatattttttagaaatacatgtaaaataccaagaaataatgtctgcgcctctgccacctctctctcatctcttatttcataaagctggctctttatgttgctttacatgccttaatatatgttttatggagattatacatattatagatctatatatgtaatatatttgtttggatgtctgatcttttcctacagttcctgcccaggcctgtttttctctcccttattttccacatcattcctagcatatcaagaccataccccttgcctttttgatccaaagaaggggagaggaaagacttattttaagacatctattttatgcttttgtttaaaaaaagcaaatctattttcaaattgtgcaatgtctgaatggaattggcaaatgaggtgaggagatggggtaactgcctttaggtcccaaccctgtgcctgtccctctgccacagtggcttccttccatcctattccccagtcacgaaagggctggtccccagagctcacccagaaagcatcttgccgggggcagggcattccctcggaagtcctggcctaaggattttattacactgtctgctcctgatgaccctctgcggttgtcaggcgtgaatcctctggaaggaactgtttgcagttgtatgcacaaaggagacccatgcaggcatgcaccccagatgggctgctagactacccctcttcatcagcctgctggaaagagcagacagcgtaacagcagcctatgccaaacagcactaaggatgtcagtgtacgagacggtgcgaagcccagaggaggcggcttgggatcctctgggccatccctggccctgtagcacagacacatacaagttccttggacttgtcacactccttttcacttgatccctctctggcctgggtcacatttatgacatcccccctctgcaacctttctctctgggggctgtaccaaaggcatggtacctcagtctggtatccagactgtgaaatcagcctctgggccaaggagggtcctacagacaaggtggcatctcaacctcacccaagaaacccccgggactttaccccagcaggctgccactggggcaccgaactaagccagctcagccttccaagctgcttagcctttgtcaaccatcaaagtggggaaagggtctctggccttgcaaggatttgggcaggatggaagtctttgtctaggtctgaaatcaagggcttgggaatctagagcagagctcctggccagcgtttgaagcctggcctcccacctggggcatttactgacaccctgtcgccagcctagaacatcctgctctgaatgaacagagcccagatgggggtccagagctaagtgacccacctggggaagctctgattattcatccagggccttctcaatgagcacattacctccatgatcaataaccaagaggctgcagtcaaatactgctactgtcactttgaagattttctaagggcacaagtggcacacttgctctccggcctttgggagaggcatgttcttgggcagggctggctacggcaagagggaaccaattcctttcccctttaggcaccctctacctggcagctcttaaaactaagaaaaaatatgatatacacacacattatatatatatatatatatacacacacacacacacacacacgtatatctatttatgcacatattggggccaatttgatttgctagtattagacaataaactgtacaaggaaatttattatctcagtgtctttatttagcataaaagtggccttagaagaagggtgaaggttagatagatggaatctctgtcaggggacaaacagctgtagcatccccttagcatctttctagccaatgagccccctccccaggaggagggatggcctgactgaaacaggtgagagtttgcttccccctttcagcagcattctttttagatttaggtactgaagaatcccagtgagttctgcatttgtatcttgcaagtttgtataaacccaatacaggaaataaaatgaatggtttgtata

SEQ ID NO: 166516 - DNA, 5091 bp, Homo sapiens
  Payload ID: 12788
  Gene Symbol: PLEKHA6
  Gene Name: pleckstrin homology domain containing, family A member 6
  ENST ID: ENST00000414478
  CDS Start-End: 318-3524
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgagggagaagcggaggagcctgcagctcccggccagcccggcccccgaccccagtccccggccagcctacaaagtggtgcgccgccaccgcagcatccatgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctactgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgtgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacgcattcctcctcagctccacccacctggagacgaatgtagccagagaggaggaaggagggaaactgaagacaccgtggcccctcggccttctctctgctagagttgccgctcagaggcttcagcctgacttccagcggtcccaagaacacctactaattcctctgcactccttcatggctgggacagttactggttcatatgcaagtaaagatgacaatttactcaac

SEQ ID NO: 166517 - DNA, 4980 bp, Homo sapiens
  Payload ID: 12789
  Gene Symbol: PLEKHA7
  Gene Name: pleckstrin homology domain containing, family A member 7
  Uniprot ID: Q6IQ23
  ENST ID: ENST00000355661
  CDS Start-End: 12-3377
gctcggcgaacatggcggcggcgacggtcgggcgggacactttacctgagcattggtcctacggggtgtgccgggatggccgcgtcttcttcatcaatgaccagctccgctgcacgacctggctgcatccgcgcaccggggagcccgtcaactcgggccacatgatccgctcagacctgccccgcggctgggaggagggcttcacggaggagggcgccagctacttcatcgaccataaccagcagaccacagcattcaggcatcctgtgacgggacagttttctccagaaaatagtgaattcattcttcaagaagagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattcctttaaggctgtgcacacggggatgcgagcgctcatctataacagctccacagcgggctctcaggccgagcagtcaggcatgaggacctactacttcagtgccgacacccaggaggacatgaacgcttgggtcagggccatgaaccaggctgcacaggtgctgtctcgatcgtcactgaagagggatatggagaaggtggagcggcaggctgtcccccaggccaaccacacagagtcctgtcacgaatgtggccgggtgggacccggacatacgagagattgtcctcatcgtggccatgatgacattgtcaacttcgagaggcaggagcaggagggagagcagtaccgttcccagagggacccactggagggcaagcgggaccggagcaaggccaggtctccgtactcgccagccgaggaggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgctccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttgaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataatggattggcgtggttcttccccaggataccttatagagtctagtgaacttttcctgtttgtggaaacaatcaggctgggtttaaatgaggacttgtctctatttggagcatttgtgagcgtgtaaggaaatgagtgttttctttgtgaatcattaaattgattttttcatctttgg

SEQ ID NO: 166518 - DNA, 539 bp, Homo sapiens
  Payload ID: 12789
  Gene Symbol: PLEKHA7
  Gene Name: pleckstrin homology domain containing, family A member 7
  ENST ID: ENST00000525581
  CDS Start-End: 82-539
actgtgaaaagcacttcttacgcctgagccatgaaatagactggaggaatgtgacctttagtcagctgtgggtctgaaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcct

SEQ ID NO: 166519 - DNA, 3688 bp, Homo sapiens
  Payload ID: 12789
  Gene Symbol: PLEKHA7
  Gene Name: pleckstrin homology domain containing, family A member 7
  ENST ID: ENST00000530489
  CDS Start-End: 1-2261
aggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgctccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataa

SEQ ID NO: 166520 - DNA, 565 bp, Homo sapiens
  Payload ID: 12789
  Gene Symbol: PLEKHA7
  Gene Name: pleckstrin homology domain containing, family A member 7
  ENST ID: ENST00000532079
  CDS Start-End: 76-309
gctcggcgaacatggcggcggcgacggtcgggcgggacactttacctgagcattggtcctacggggtgtgccgggatggccgcgtcttcttcatcaatgaccagctccgctgcacgacctggctgcatccgcgcaccggggagcccgtcaactcggggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgaccta

SEQ ID NO: 166521 - DNA, 4561 bp, Homo sapiens
  Payload ID: 12789
  Gene Symbol: PLEKHA7
  Gene Name: pleckstrin homology domain containing, family A member 7
  ENST ID: ENST00000531066
  CDS Start-End: 43-3858
ccccctcccccccaccccgcggcggctccgcgctcggcgaacatggcggcggcgacggtcgggcgggacactttacctgagcattggtcctacggggtgtgccgggatggccgcgtcttcttcatcaatgaccagctccgctgcacgacctggctgcatccgcgcaccggggagcccgtcaactcgggccacatgatccgctcagacctgccccgcggctgggaggagggcttcacggaggagggcgccagctacttcatcgaccataaccagcagaccacagcattcaggcatcctgtgacgggacagttttctccagaaaatagtgaattcattcttcaagaagagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattcctttaaggctgtgcacacggggatgcgagcgctcatctataacagctccacagcgggctctcaggccgagcagtcaggcatgaggacctactacttcagtgccgacacccaggaggacatgaacgcttgggtcagggccatgaaccaggctgcacaggtgctgtctcgatcgtcactgaagagggatatggagaaggtggagcggcaggctgtcccccaggccaaccacacagagtcctgtcacgaatgtggccgggtgggacccggacatacgagagattgtcctcatcgtggccatgatgacattgtcaacttcgagaggcaggagcaggagggagagcagtaccgttcccagagggacccactggagggcaagcgggaccggagcaaggccaggtctccgtactcgccagccgaggaggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgctccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttgaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcatggaagcgtgagcaggactttgacctgcagttgctggaacgggtcgtgcaaggggaaaaaaaggacaaggaggagaatggctggttgaaagtgcaggccatgcctgtcactgagttggacctggagcctcaagactatgacttggacatcagcagagagctgtccaaaccagagaaggtgtcaatccctgagcgctacgtggagctagatcccgaagagccacccagccttgaggagctgcaggcgcggtaccgcaaagccgagaagatccgcaacatcctcgcccggtcaagcatgtgcaacctacagccgacctcaggccaggaccagaacagtgtggctgacctggacttgcagctgcaggagcaggagcgcatcatcaacatctcctacgccctggcctccgaggcctcccagcgtagcaagcaggtggcagcccaggcagtgactgacccgtgacccagcatgcaaagaagcctggagccaggggcccagtggaaccagcttcctccaaggagatgacctttctgcccccaaggaaaccccttccagctgagcagggaatccggccggaggaaggagcagcttaccgactgcgggtgttcaccacaggccaggccctaatatgcacccactagtttagctcagactcctctctacatatgaatggcaaaggcacttttgatatacactgtaaaatacactgtattttagaatcggaatctattttctaatgttcccctcaagggctgagtggcaggaaggttgaggatgcaggactttgcagctgcacgtacagattcaggtacttctgggtgacaggtgttgtgggggcaggaagggcggggcaagccgaggctagtccaacttccaatgacctcaggagaaagtgagatttaaagaggtgttcccagtagactccagcaagaggctggttggcgtgctgtctgggagaagaggggcccttggctgcagagatcagctgtccctgacctgatgaccagctctgtgtgaaactccacgaggatcacacgtggagcccaagtctgtgccttgccccttgggtttggcttaggggcaacagtgtgttcaagaggactggggcccacaacctgcccccaggcttcctccagcaaaaggctcttgtcagaaagaaaaaagc

SEQ ID NO: 166522 - DNA, 543 bp, Homo sapiens
  Payload ID: 12789
  Gene Symbol: PLEKHA7
  Gene Name: pleckstrin homology domain containing, family A member 7
  ENST ID: ENST00000528376
  CDS Start-End: 173-543
ctgacctgaacctaagatttaataaggtggtgcagctggggaagacactatccgaacgtggagcccaaagggaggccataaccagcagaccacagcattcaggcatcctgtgacgggacagttttctccagaaaatagtgaattcattcttcaagaagagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattc

SEQ ID NO: 166523 - DNA, 2016 bp, Homo sapiens
  Payload ID: 12790
  Gene Symbol: PLEKHB1
  Gene Name: pleckstrin homology domain containing, family B (evectins) member 1
  Uniprot ID: Q9UF11
  ENST ID: ENST00000227214
  CDS Start-End: 230-799
actccccctccctggggtgggcaggtccggagggcggggcccgggggcagctgggctctcaggcgctgcgggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 166524 - DNA, 2380 bp, Homo sapiens
  Payload ID: 12790
  Gene Symbol: PLEKHB1
  Gene Name: pleckstrin homology domain containing, family B (evectins) member 1
  Uniprot ID: Q9UF11
  ENST ID: ENST00000354190
  CDS Start-End: 432-1163
aagagaggaaggcttaaagagccagactgcgcagccaggactggggtgatgggcgctgtcctgccaggccaaagaatgaagatgtagccccgcccccaacctagggaggaggaccagcccggttcctgtcctgcccccgcaacctcgccccgattccactccgggaacctcggcgatgctgagccaagaccacttctgaatcagggatgacttgtctagtgaacctagggtcagagccatcagttggaaaggctgggaggagcctggagaaagagggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 166525 - DNA, 2275 bp, Homo sapiens
  Payload ID: 12790
  Gene Symbol: PLEKHB1
  Gene Name: pleckstrin homology domain containing, family B (evectins) member 1
  Uniprot ID: Q9UF11
  ENST ID: ENST00000398492
  CDS Start-End: 432-1058
aagagaggaaggcttaaagagccagactgcgcagccaggactggggtgatgggcgctgtcctgccaggccaaagaatgaagatgtagccccgcccccaacctagggaggaggaccagcccggttcctgtcctgcccccgcaacctcgccccgattccactccgggaacctcggcgatgctgagccaagaccacttctgaatcagggatgacttgtctagtgaacctagggtcagagccatcagttggaaaggctgggaggagcctggagaaagagggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 166526 - DNA, 2061 bp, Homo sapiens
  Payload ID: 12790
  Gene Symbol: PLEKHB1
  Gene Name: pleckstrin homology domain containing, family B (evectins) member 1
  Uniprot ID: Q9UF11
  ENST ID: ENST00000398494
  CDS Start-End: 170-844
aggcgctgcgggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 166527 - DNA, 567 bp, Homo sapiens
  Payload ID: 12790
  Gene Symbol: PLEKHB1
  Gene Name: pleckstrin homology domain containing, family B (evectins) member 1
  ENST ID: ENST00000535582
  CDS Start-End: 217-567
aaagcgcaggcgcagcgggttgggtggcagcagcatcgagtagcggccgcttaggcagcaacatccgcaacaagtgtagacaagacattctgatttaattgttacggagtgtggcctggtatcggaagttctcaaagctcctgccggcataacggtttgaagccaggactgctgggtgtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccg

SEQ ID NO: 166528 - DNA, 562 bp, Homo sapiens
  Payload ID: 12790
  Gene Symbol: PLEKHB1
  Gene Name: pleckstrin homology domain containing, family B (evectins) member 1
  ENST ID: ENST00000546251
  CDS Start-End: 124-562
aaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccgatgataagactgaagctcattcatccgcacaacaaatatttactgagctgctactatgggccaggtggtgtgccaagtgccagggatcagaggtgcgcgtctacag

SEQ ID NO: 166529 - DNA, 618 bp, Homo sapiens
  Payload ID: 12790
  Gene Symbol: PLEKHB1
  Gene Name: pleckstrin homology domain containing, family B (evectins) member 1
  ENST ID: ENST00000542389
  CDS Start-End: 138-618
aaacgtttcctgggtggctccccagggacggcagggctgggggcttctctccagggagctgctgctgaggcctgtgtctcccgtggctcctctgacaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgc

SEQ ID NO: 166530 - DNA, 433 bp, Homo sapiens
  Payload ID: 12790
  Gene Symbol: PLEKHB1
  Gene Name: pleckstrin homology domain containing, family B (evectins) member 1
  ENST ID: ENST00000536527
  CDS Start-End: 229-433
gggaaatgctgccctggccacccaggaaccatgagccctgcagccccggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatggtgagccaggcacag

SEQ ID NO: 166531 - DNA, 632 bp, Homo sapiens
  Payload ID: 12790
  Gene Symbol: PLEKHB1
  Gene Name: pleckstrin homology domain containing, family B (evectins) member 1
  ENST ID: ENST00000543085
  CDS Start-End: 153-569
agaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagaatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggacc

SEQ ID NO: 166532 - DNA, 579 bp, Homo sapiens
  Payload ID: 12790
  Gene Symbol: PLEKHB1
  Gene Name: pleckstrin homology domain containing, family B (evectins) member 1
  ENST ID: ENST00000540431
  CDS Start-End: 40-579
gtcccgcctgactccgctctggaaagtccttttgaagaaatggccctggtgaggggcggctggctgtggagacagatgcatctggaatatcgtacaggctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagcc

SEQ ID NO: 166533 - DNA, 685 bp, Homo sapiens
  Payload ID: 12790
  Gene Symbol: PLEKHB1
  Gene Name: pleckstrin homology domain containing, family B (evectins) member 1
  ENST ID: ENST00000541597
  CDS Start-End: 196-685
ggcaagtgagtcgccctcaggaacagagggcacctacctggattccagtgcaagctacatcatgtacatggatgagtcatttgctaaccctcagtttgtccatctgtaaaacaggagtaaggattcccttcctaacagggttagagtggggacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgccc

SEQ ID NO: 166534 - DNA, 1049 bp, Homo sapiens
  Payload ID: 12790
  Gene Symbol: PLEKHB1
  Gene Name: pleckstrin homology domain containing, family B (evectins) member 1
  Uniprot ID: Q9UF11
  ENST ID: ENST00000535129
  CDS Start-End: 362-931
acttctacagatctagaaactgagaccaggacagagggccagggaggagggatatggccaaagttaccaagctgaggctggaatccaggctcctggtccccacccccaccccacaccaatggctgccctgctgaccccacagtgacagtgctcccattctcttcctgagcagagaatggggaggaggccgaggccgcctggcccttgtttactaaccctccctcaaacgtttcctgggtggctccccagggacggcagggctgggggcttctctccagggagctgctgctgaggcctgtgtctcccgtggctcctctgacaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagct

SEQ ID NO: 166535 - DNA, 534 bp, Homo sapiens
  Payload ID: 12790
  Gene Symbol: PLEKHB1
  Gene Name: pleckstrin homology domain containing, family B (evectins) member 1
  ENST ID: ENST00000545798
  CDS Start-End: 281-534
aaagcgcaggcgcagcgggttgggtggcagcagcatcgagtagcggccgcttaggcagcaacatccgcaacaagtgtagacaaggtgggtgcatcaaggggaggggctggaaaaggagtctgcacctgaccctcttgtctgatctgtgtcaagaccgtggagaggggagggagcggcaagaggaacagacaaggctgggccttccagcccaggtgtgccagcccttgttacgcagcaacaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcgg

SEQ ID NO: 166536 - DNA, 656 bp, Homo sapiens
  Payload ID: 12790
  Gene Symbol: PLEKHB1
  Gene Name: pleckstrin homology domain containing, family B (evectins) member 1
  ENST ID: ENST00000543524
  CDS Start-End: 193-656
aacatccgcaacaagtgtagacaaggtgggtgcatcaaggggaggggctggaaaaggagtctgcacctgaccctcttgtctgatctgtgtcaagaccgtggagaggggagggagcggcaagaggaacagacaaggctgggccttccagcccaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcggga

SEQ ID NO: 166537 - DNA, 577 bp, Homo sapiens
  Payload ID: 12790
  Gene Symbol: PLEKHB1
  Gene Name: pleckstrin homology domain containing, family B (evectins) member 1
  ENST ID: ENST00000538227
  CDS Start-End: 124-577
aaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggtaagtctccagcgtgccccg

SEQ ID NO: 166538 - DNA, 586 bp, Homo sapiens
  Payload ID: 12790
  Gene Symbol: PLEKHB1
  Gene Name: pleckstrin homology domain containing, family B (evectins) member 1
  ENST ID: ENST00000539157
  CDS Start-End: 124-586
aaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagatgcatctggaatatcgtacaggctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgc

SEQ ID NO: 166539 - DNA, 4208 bp, Homo sapiens
  Payload ID: 12791
  Gene Symbol: PLEKHB2
  Gene Name: pleckstrin homology domain containing, family B (evectins) member 2
  Uniprot ID: Q96CS7
  ENST ID: ENST00000234115
  CDS Start-End: 464-1129
cttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaatcctggagaagccagaacaatatacaaacaagtatgtggaggcagatttgctttattccaagaggctgtttgagtgtgtgtctgcctaagcctccttatagcctatttttctacttgctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatgtttca

SEQ ID NO: 166540 - DNA, 1167 bp, Homo sapiens
  Payload ID: 12791
  Gene Symbol: PLEKHB2
  Gene Name: pleckstrin homology domain containing, family B (evectins) member 2
  ENST ID: ENST00000404460
  CDS Start-End: 55-984
cgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggagctgcacagtaaaggtcccaaaatacacaccaccacgagtgcaaaaacccaggcggttctcccaacgcgatgtttttttcccagcgaatctccgataagaaggtctgtgcagatttctgtgctcctacctgcagtaaatattcgtagacgtataaagctaacttttccccagcctgcccgtccgagggcaccaaggagcctttgcctttggcaaacatggtttgcagggaagagggcgcccagcctccccacagccgccaccgctccggctctcccgagctgcccctcgcccccggccccctcccaggcgctccctccctctctcgctggctggcgctctcctagcagcgctcccctccctcccgagcaggcgctggctccgcgctctttccagctgtcaaagcatcaggcccggccgcggccccatcgccctggaactcctcccgtgccggcttggcctggggtgccgccgccgcctcccgcaaggccgcccgctctccggtagctcgcgtgctcgcccggttccgcttgcgcggccctctgcgcccccagcaccgctgccgccgccgccggcgctggcctcatgtgtcacattttcttaatccagtctatggctgatggatatttgggttggttccaactttttgctattgtgaatagtgccgcaataaacatacgtgtgcatgtg

SEQ ID NO: 166541 - DNA, 4349 bp, Homo sapiens
  Payload ID: 12791
  Gene Symbol: PLEKHB2
  Gene Name: pleckstrin homology domain containing, family B (evectins) member 2
  ENST ID: ENST00000403716
  CDS Start-End: 561-1271
atactttaggttataacttaatgcaatgtactttatattgctgctcaaattgtcccaggcgcggcccccggaagctctctgggtagatccctgcgcccttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcagagaccatcctcatgacacgtcattgcactgcagtttccaggggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaatcctggagaagccagaacaatatacaaacaagtatgtggaggcagatttgctttattccaagaggctgtttgagtgtgtgtctgcctaagcctccttatagcctatttttctacttgctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatgtttc

SEQ ID NO: 166542 - DNA, 2277 bp, Homo sapiens
  Payload ID: 12791
  Gene Symbol: PLEKHB2
  Gene Name: pleckstrin homology domain containing, family B (evectins) member 2
  Uniprot ID: Q96CS7
  ENST ID: ENST00000409158
  CDS Start-End: 561-1253
atactttaggttataacttaatgcaatgtactttatattgctgctcaaattgtcccaggcgcggcccccggaagctctctgggtagatccctgcgcccttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggtagggagaaccctgagcctccagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctc

SEQ ID NO: 166543 - DNA, 2210 bp, Homo sapiens
  Payload ID: 12791
  Gene Symbol: PLEKHB2
  Gene Name: pleckstrin homology domain containing, family B (evectins) member 2
  Uniprot ID: Q96CS7
  ENST ID: ENST00000409612
  CDS Start-End: 518-1186
gaaagagagctggagaactgggatatcatgaggagttgtagacagttaaacctgaattctagcttttggaacaaaatagtaatgtaattgtagcagttctcacttttttattttttatttttttgagacggagtttcactcctgttgcttaggctggagtgcgatggcgcagtctcggctcactgcaacctccgcttcccgggttcaagggagtcccctgcctctgccccccaaatagctgggattacaggcgtgcgccaccatgctcggctaattttttgtatttttaatagagatggggtttcactatgttggtcaggctggtctcgaactcctgacctcaggtgatccgcctgccttggcctcccaaagtgttgggattataggcgtgagccaacgcgcctggccaattctcacttttggaccatctactacagggctgtttggacatacctcctttaattgtcacagtaaccccatgacgtaattggttgtgcctggtcatacaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctc

SEQ ID NO: 166544 - DNA, 2488 bp, Homo sapiens
  Payload ID: 12791
  Gene Symbol: PLEKHB2
  Gene Name: pleckstrin homology domain containing, family B (evectins) member 2
  Uniprot ID: Q96CS7
  ENST ID: ENST00000409279
  CDS Start-End: 796-1464
aaaaaaaagctaaagcagaaaacaaaagtggcccatggtctcagcttccagataataactattgatttcaaaaaataaaatggcctgggattacaggcatgagctgctgcgcccggccaatttttgtatttttagtagagatgaggtttcaccatgttggccaggctggtctcgaattcctgacctcaggtgatccaccctcctcggcctgagccaccgtgcccagccgtgactgtttcttctaatttatcacttttaaagtctcatttaactttttttccatacagaagatttaaatttttatggagttgactttatgaacctttttcttgatgacttttgtttttttgccctgacctggccactccacgtcactcactgctgacaccagtgcagcacccctgcctgggccatgtggaccccactgggaacgccaaatgtaggcacctcagggctccagcaagccacgagaatcccccatgtccttgacagagctaaatcctgtgtccctggggctgctttatgtttgttgagtggtgttagactcggtcaggtgggctgggtggtgaggctgaaggcgagtgtgggaggaagggagggggtacagagtgcggggcacatgaaccccaatgaggaggtgtttgttaaatgccaggggggcactgagctaaaatggccttgggcccttcctcagctgatgctgaaggggataaggatagagactcgggccggacaggctattctctttctgggtatgattttgaacctgcctgtttttgttctgtaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctc

SEQ ID NO: 166545 - DNA, 4177 bp, Homo sapiens
  Payload ID: 12791
  Gene Symbol: PLEKHB2
  Gene Name: pleckstrin homology domain containing, family B (evectins) member 2
  ENST ID: ENST00000439822
  CDS Start-End: 561-1076
atactttaggttataacttaatgcaatgtactttatattgctgctcaaattgtcccaggcgcggcccccggaagctctctgggtagatccctgcgcccttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaatcctggagaagccagaacaatatacaaacaagtatgtggaggcagatttgctttattccaagaggctgtttgagtgtgtgtctgcctaagcctccttatagcctatttttctacttgctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatgtttc

SEQ ID NO: 166546 - DNA, 1460 bp, Homo sapiens
  Payload ID: 12791
  Gene Symbol: PLEKHB2
  Gene Name: pleckstrin homology domain containing, family B (evectins) member 2
  Uniprot ID: Q96CS7
  ENST ID: ENST00000438882
  CDS Start-End: 72-608
agttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccat

SEQ ID NO: 166547 - DNA, 1297 bp, Homo sapiens
  Payload ID: 12791
  Gene Symbol: PLEKHB2
  Gene Name: pleckstrin homology domain containing, family B (evectins) member 2
  Uniprot ID: Q96CS7
  ENST ID: ENST00000628582
  CDS Start-End: 106-618
gtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttgcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggta

SEQ ID NO: 166548 - DNA, 4865 bp, Homo sapiens
  Payload ID: 12792
  Gene Symbol: PLEKHD1
  Gene Name: pleckstrin homology domain containing, family D (with coiled-coil domains) member 1
  Uniprot ID: A6NEE1
  ENST ID: ENST00000322564
  CDS Start-End: 213-1733
ccggagcccaagccgccggctacgcgccctgcgcccccttggtgccgcgtccagtgcccagcgcgctttgatgctgcagctccgggccgggccgctctgcttctctgctcgctgggacgctctccgacggctccgccctcgcctctcgccccgagtccctgctgaccccggggaggtggggtccgggccgggcacagccccgctgaggcaggatgttcacgtccaagtccaactcggtgtcgccctcgccgtccctggagcaggctgactcggacgccctggatatcagcaccaaagtgcagctctacggcgtgctgtggaagaggcctttcggcaggccgtcggccaagtggtcccggcggtttttcatcatcaaagagagctttctgctttactactctgagagcgaaaaaaagagctttgaaaccaataaatacttcaatatacatcctaagggcgtcatccctctggggggctgcctggtggagcccaaggaagagcctagcatgccctatgccatgaagatctcccaccaggacttccatgggaacatcttgcttgctgctgagtcggagtttgagcagacccagtggctggagatgctgcaggagtctgggaaggtgacctggaagaatgcccagctgggagaagccatgatcaaaagcctggaggcccaggggctgcagttggctaaggaaaagcaggagtatttagacaaactgatggaagagaccgaagaactctgccttcagagggagcagagagaggagcttgagcgccttaaccaggtgctggaggccgagaagcagcagttcgaggaggtggtgcaggagctgagaatggagcaggagcagatcaagagggagctggaactgactgcaagatgccttaagggtgtagaacaagagaaaaaggaactgaggcacctcacggagtccttgcagcagacactggaggaactctccatagagaagaagaaaaccctggaaatgctggaggagaacgagaaccacctgcagacactggccaatcagagtgagcagccccctcccagtgggggcctccatagcaacctccggcagatcgaggagaagatgcagcagctcttagaggagaagctcctggcagagaagcggatgaaggagaacgaggagcgctcacgggccctggaggaggagcgtgagttctactccagccagtcccaggcactgcagaactcgctgcaggagctgacggcagagaagcagcaggctgagcgggagctcaaggctgaggtgaaggtccgcatggacctggagaggcgtctccgggaggcagaaggggccttgcgaagcctggaacaggggctgaattccaaggtgcggaataaggagaaggaggagaggatgcgggctgatgtgagccatctgaaaaggttctttgaggagtgcatccggaatgccgagctggaggccaagatgcctgtgatcatgaagaactccgtgtacatccataaggcagccactcgccgcatcaagagctgccgcttccaccgacgccggtccagcacctcctggaatgacatgaagccgtcccagtccttcatgacctcccagctggatgccaacaacatggaggagctaaaggaggtggccaagcggctcagcagggaccagcgcttccgggaatccatctaccacatcatggccacccagcctggagccccctcggcactctcccggggtggaaagtgatgggcgctcctcccctgcttcccaagtctcccctggatgggcgggggaggggaaggggtggcagagggaggcctcactctaccagctcctggcctctctggtctggagcctatgtctcctctgggccggagctccacttgggggccagccttgccctcaaaggacatggacgctgccttcctcatcctcaccccacaccccacctttgggtccacaccagggccatgcaggcctgagctgggtgctggttgtcatggtgaggtgaggacaggacctggttgtatgtggagatttgtgtcggttagggagtggggtggggaggtgctgtctaccactgtgccatcaggcagggtctgccccactgaggaagatggcagccctccctggtgcccactggacctctctgggactctgctgccctgcccgtggtcctcatgtagaaaggccttgcctccctaccttgacattcccttttccccagggtttcctaaccctccctttgcttctgacactcagcaaaatgtccctcagctgagacccctcatttacaccacatcatgctgtgcaggaggaaaggggcctaggacagcagcttctgggctcctgacataccacacacccgccacagtgccgcttttcctgagctcaggccctggctgtggggccacccactgattcccctcctcctctggtgagctcactcacagccttggcaccctgcaagggtagaatgatggcaccagtccctcctgcctgtgtacctagggccctggctgggagctggggccagcagtgatgctgggggctcccccagaggacacgtaacaagctcaggagtgggctgggcacagtggctcatgcctgtaatcccagcactttgagaggccgaggcgggaggattacttgaagtcaggagtttgagaccagcctggccaatacggcaaaaccctgtctctacaaaaaataaaaaaaataaaataaatagctgggcatggtggtgcatgcctgtagtcccagctacttgggagactgaaatgaggggattgattgagcctgggaggttgaggctgcagtgagctgagattgtgccactgcactccagccagggtaacagagcaagaccctgtctcaaacaaacacaaggaaaacaagctcaggagtgaaggaaagtcactctggttcctgcattatgtacttctggttgcgcagggaggcagtgttcctgctggtcgagagatcacagatatctccttcccagctgcccctgcttcagtcaccttgctgcctcctctccctgcagagatttcagcctgtgaagcaatgtgaccatgaactctggcagctggggaccctgggcctgtgatgaggccagtagtcattggttggctcagtgtcattgggagtgaagctgaaacgccaatctgcagcttctgtggaagaccaccaccctccagggggctgaagggtgtgtctgtctctcactcatggacagacagactgcccagaccctctccctgcaggcccaccctccaaagctacctgaggctattggcctccagaaaaggggtccacctgggatcagggtgctcttggacactgttgacattaaaggtgctcattctttgctgcttggaaaaccaagaagttctgagagataaacagatggcttcggggcaagtcccagcaaaaagtgcaagaacctgggagcccacaacctattctgtgggaagaggagcattgttgcctctaagaacacatgcacatctgctgctaggctggccgagcccaggccgggctgccctgctctttgctcagtgcttcctgccaaaactaatctcagtggttcctttcagtgatgggtggactttggtggcttcatacagtctctgcagaatctagctggggagagggctgagtcagtttggaataaatgcatttgacagggctgagcctaaatgtaaaactttaaacgtgtataacatgcataaacctggaacttgtttctctaacacgtatgaaggatgaactttgaattgaaggggaatatttataaaaccaagattactgtttccttttttttaaaagaattaatcatggcttgcttttagagagatctttcataattttcagatgcatttgtttttcttgggcgagctattaaccagacaggaaagtgctagtcttcgtttgctttgtactgctgtaacagaatacctgagactgggtaatttataaggaacagaaatgtactggctcacagatatggtggctaagacgtccaatatcaaggtgctggcatctggcaaggaccttcttgttgcatcatcccatggttgacaggcaaagagagggtgagagagcaagaggggccaaacttattcttttataacaaacccaccccctcgataatgacattaatcctttcataagggagagtcttcatggccaaatcacctcttaaatgttccacctcttgcggatcacctgaggtcaggagtttgagaccagcctggccaatatggcgaaaccccacctgtactaaaaatacaaaaattagctgggcgtggtggtgggtgcctatagtcccagctactcaggaggctgagacaggagaatcacttgaacctgggaggtggaggttgcagtgagccgagattgtgctattgtactccagcctgggcaacatgagtgaaactctgtctcagaaaaaaaaaaaaggtcccacctcttaatattgttacaatggcaatcaaatttctttttttaatcctgcaaactactgggatagtaattaaatttcagtgtgagtttgggagggaacaaacattcaaactgtagcagtgcttttccatgcacatttaccaatcgatacttcctcctattctcaccctgtattttccatgcctcaggcaagtctgaattatcttcagccaactgaacaatccataagtgtttattcgttaaaagctcactatgtacctagcactgtaaatagaaaaatagcaacatctctatatcaaaatacgtaggagtggaaattacttagtggagatatgttgatgtaatttttttaatttttaaaaacaaaactcttattccttggccaattaaatgcatttcctgcagtatcta

SEQ ID NO: 166549 - DNA, 2084 bp, Homo sapiens
  Payload ID: 12793
  Gene Symbol: PLEKHF1
  Gene Name: pleckstrin homology domain containing, family F (with FYVE domain) member 1
  Uniprot ID: Q96S99
  ENST ID: ENST00000436066
  CDS Start-End: 467-1306
tgaccgctgagggtgactgtgctgtgaggcccgccggaggcaccagaaggcacaagcctcccactgcccctttccccgccaagtcccgcaggtctcgcagtcgcgggcgcccccaccccacccctgcccaaggccagggtcgcagtcccaccgggtgacggcagtcgcgctccgcgtggggcagcggcgagcggaaagggaagccgggcggggccagggggtcaaacacgggcgacagtcccgcccagccccggacctgcagcgcgcacaagctcgggcgccctccgagcgccgcgcccaagccccgcccctcccgcttcccgggctccgattggccgagccaccgcgggggcgtgtccggcggagctggccgggacccgggcggagcgggcggggacccgggctactgcggtgtggactcgagggctgggcgcggggccggcgcagaagccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcggcttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggagcgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacactgtgtccttatggcttcactgcaggtaatgcctttcccttcaggaagccccagaacacccacaggtcttggtaacaaacgccaccttacactctgcaggctgcagcggcagctccagatggcctcctgagctggacgaccccaggtctccagacatctagggaccagagcaggtttgggaacacagagggaagacaggatgggagtgtagccacagaacccacctgcaccctgacaggcacaccccactgaagagcctgagtcccaggaggcctcctggaagcccaggactgcccacccaccacgctggtgcccaccgcctggccagccaagccctgccgatcagacatgtgggctccccgaagcccagccagagactgccgtgctgtgggtgccaccaggcccagggactgcagcctgagctccccgaggcccagggcagccgggtgaggactctgtcctgtgtcacctctctccaggtgtccagctgtctcatgcctttttgtcctgtcctcagctctccgtgtggtcagcgaaaccattgttttctgttaggactcagttgcaagaacagaaaccctgcccccacttaataataaaaaagaaagtttattg

SEQ ID NO: 166550 - DNA, 543 bp, Homo sapiens
  Payload ID: 12793
  Gene Symbol: PLEKHF1
  Gene Name: pleckstrin homology domain containing, family F (with FYVE domain) member 1
  ENST ID: ENST00000588833
  CDS Start-End: 298-543
agaaggtgagtccccccaccgtcccccggccgggctgcgggtcgcggggcaggcgcatgaggcgagtctcccatcaccacccccggacaagcgagctctctcccgccgcgcggtcttggcggctcctgggccggcggggcgcagtgccgctgactccagcccaagaagaggcctgggaagggcgctcctgggcggcttgcggggtgaacctgcagggagcctggggagagcggtcaggggtcagagcgtccgaggcggaatccccggggaaacgcgcagatccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctg

SEQ ID NO: 166551 - DNA, 707 bp, Homo sapiens
  Payload ID: 12793
  Gene Symbol: PLEKHF1
  Gene Name: pleckstrin homology domain containing, family F (with FYVE domain) member 1
  ENST ID: ENST00000586888
  CDS Start-End: 324-707
ccggtctcttcccggaggagggccttccaggaatcacagggctggacagagcccaggggcggcccctctggagggagaggaggcttggcgcctgatgctgcagtctcaatgcacatggagaaaacctcacatcctcacgctggcctgggagcctgcaggatgtctcctgccggcactgcaacctcatctgtcctccttgccccatcgctccttcctccgcagcctgacttcacccattccaccttgagctgctccccaggaccggagctctgcccctagatctttgcacagctgacttcaggctggaccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggag

SEQ ID NO: 166552 - DNA, 1357 bp, Homo sapiens
  Payload ID: 12793
  Gene Symbol: PLEKHF1
  Gene Name: pleckstrin homology domain containing, family F (with FYVE domain) member 1
  Uniprot ID: Q96S99
  ENST ID: ENST00000592810
  CDS Start-End: 354-1193
ctactgcggtgtggactcgagggctgggcgcggggccggcgcagaaggtgagtccccccaccgtcccccggccgggctgcgggtcgcggggcaggcgcatgaggcgagtctcccatcaccacccccggacaagcgagctctctcccgccgcgcggtcttggcggctcctgggccggcggggcgcagtgccgctgactccagcccaagaagaggcctgggaagggcgctcctgggcggcttgcggggtgaacctgcagggagcctggggagagcggtcaggggtcagagcgtccgaggcggaatccccggggaaacgcgcagatgtaagctggtggagccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcggcttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggagcgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacac

SEQ ID NO: 166553 - DNA, 2881 bp, Homo sapiens
  Payload ID: 12794
  Gene Symbol: PLEKHF2
  Gene Name: pleckstrin homology domain containing, family F (with FYVE domain) member 2
  Uniprot ID: Q9H8W4
  ENST ID: ENST00000315367
  CDS Start-End: 242-991
cgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactt

SEQ ID NO: 166554 - DNA, 1144 bp, Homo sapiens
  Payload ID: 12794
  Gene Symbol: PLEKHF2
  Gene Name: pleckstrin homology domain containing, family F (with FYVE domain) member 2
  Uniprot ID: Q9H8W4
  ENST ID: ENST00000519516
  CDS Start-End: 271-1020
ggaggggagacgcgaaactttccgggcgcttcctcccgcggtcccggagccgtcgcagcgccgggaggtgtcgtcgtcgcgggcggtggcggccgacgccatgttggggtctgtgagaaacggggcgctcccggccgctcccctcgcgccggggccggcccgcgggccagttgccgccgccgtcccgccagcccgggagcgagccgcgcccgcccgtaggacgccgccgccgccgcggggggacgggggccgccgggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaac

SEQ ID NO: 166555 - DNA, 7138 bp, Homo sapiens
  Payload ID: 12795
  Gene Symbol: PLEKHG1
  Gene Name: pleckstrin homology domain containing, family G (with RhoGef domain) member 1
  Uniprot ID: Q9ULL1
  ENST ID: ENST00000358517
  CDS Start-End: 212-4369
aatatttctacggaaggcgctgcacagactagcaaaggctgtttcttttacctgactgaggtcactgcatcagctgaaggcagacgatgtgcttaagcctgagtggagcagagatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggtaa

SEQ ID NO: 166556 - DNA, 478 bp, Homo sapiens
  Payload ID: 12795
  Gene Symbol: PLEKHG1
  Gene Name: pleckstrin homology domain containing, family G (with RhoGef domain) member 1
  ENST ID: ENST00000367326
  CDS Start-End: 339-478
ccgagcctgagcccgagcccgagcccgacggcggctgcagggcgctccggcagcccgagccggcgcagcgcagcccgcaccctccccgcccgacctgcgagcgccgcccgggcatgcgaagccgtccctccccgggaaaggagagtgaatatctatggatattgccctggcccttaagaaggtgaagactgatgagaagagtctgtgggtgaagacattgaaaaggtttcaactataaaaatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataa

SEQ ID NO: 166557 - DNA, 7237 bp, Homo sapiens
  Payload ID: 12795
  Gene Symbol: PLEKHG1
  Gene Name: pleckstrin homology domain containing, family G (with RhoGef domain) member 1
  Uniprot ID: Q9ULL1
  ENST ID: ENST00000367328
  CDS Start-End: 313-4470
gaggaagaggaagtcggagcccgagcctgagcccgagcccgagcccgacggcggctgcagggcgctccggcagcccgagccggcgcagcgcagcccgcaccctccccgcccgacctgcgagcgccgcccgggcatgcgaagccgtccctccccgggtgaagactgatgagaagagtctgtgggtgaagacattgaaaaggtttcaactataaaaatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggt

SEQ ID NO: 166558 - DNA, 1476 bp, Homo sapiens
  Payload ID: 12795
  Gene Symbol: PLEKHG1
  Gene Name: pleckstrin homology domain containing, family G (with RhoGef domain) member 1
  ENST ID: ENST00000475490
  CDS Start-End: 1-1179
gaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcagcacaacttttggaaatggctgacgatgcagcccggattgtactgtagcacatgttggcatcaacagtatattttctcatgctgagtgtcttcatgtttcatagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctga

SEQ ID NO: 166559 - DNA, 4209 bp, Homo sapiens
  Payload ID: 12796
  Gene Symbol: PLEKHG2
  Gene Name: pleckstrin homology domain containing, family G (with RhoGef domain) member 2
  ENST ID: ENST00000205135
  CDS Start-End: 1-3764
agcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaa

SEQ ID NO: 166560 - DNA, 2205 bp, Homo sapiens
  Payload ID: 12796
  Gene Symbol: PLEKHG2
  Gene Name: pleckstrin homology domain containing, family G (with RhoGef domain) member 2
  Uniprot ID: Q9H7P9
  ENST ID: ENST00000409797
  CDS Start-End: 250-1983
ctgcaggaccctggcatccggtcccccagcctccgccctcccctgggaccccgcggcctcccgcccacggcttttcccagccctgcccctcgccctccgctccagctggagcccaaacgttcccaggatccctaagcctccggccccagacaaacgggactcgcagcttctgcgcctcctgctccgctcactcttctttgtctcagcctttccatctttttcgccaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccaggggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaa

SEQ ID NO: 166561 - DNA, 8132 bp, Homo sapiens
  Payload ID: 12796
  Gene Symbol: PLEKHG2
  Gene Name: pleckstrin homology domain containing, family G (with RhoGef domain) member 2
  Uniprot ID: Q9H7P9
  ENST ID: ENST00000425673
  CDS Start-End: 851-5011
atgtgagccccggcgacagcgggggaggggaagccccgggcgaccgccccccgcctcacagctgggatcggactctcccgccccagatgtggcgccgccgccgtcacacgagccccgtgacacccagccgggagcccgaggggtccagaggctcggacccgggcgtccggaatttctgcaccgcatcctgagagaccccgaggtccagaccccggcgcccaggctggaggacttgagccatccaggtgcgcagcgccccctcctggagcagccgggagcccggacgtcaccccgcgagaccctggaggccgagcgccccgtatccccgtttcaagaactcaggatccaggaccgcagactccctccagggctccgatcccaagaccccgcgttggaggaacttgagatccggacttctaagcgccccaaccagtttcgggctgcagcggccatcgcttcaaggggacccaggactttgggacccccctgtgctcccacctggagggagtttcattcctgcccctagaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttgcttaggagcatcattcaaatcacagatcccccagtatctagtcccaacctattgaatcaggatccccagggaaggaggagcttgggaatctgatttttttttttttttttagataaagtctcactctgtcacccaggcttgagtgcagtggcaaaatcttggctcattgcaacctccacctcctgggttcaagcaattctcatgcctcagcttcccgacatagctgggattataggcgtgcaccaccatgcccagctaatttttcgttgttgttgttgttgttttgtttttgagacagagtctcgctctgttgcccaggctggagtacagtggcacgatcttggctcactgcaagctccgcttcccgggttcacgccattctcctgcctcagcctcccgagtagctgggaccacaggtgcccgccaccacgcccggctaatttttttggtatttttagtagagacggggttttaccatgttagccaggatggtctcgatctcctgacctcgtgatcctcccgcctcggcctcccaaagtgctggcattacaggcgtgagccatcattcctggctgggaatccgaatttttttttttttttagacggagtttcgctcttgttgcccaggctggagttcaatagcatgatctcggctcactgcaacctctgcctcccaggttcaagtgattctcctgcctctagctgggattgcaggcgcccacgaccacgcccagctaatttttgtattttgtagtagagacgggatttcgccatattggccaggccatagtggtcttggactcctgacctcaggtgatccgcccacctcggcctcccaaagtgttgggtttacaggcgtgagctaccataccctgcccaggaatctgaatttttagcaatcagttagcagcaaataagctgagatttcctgggtactaagcacatactatgagcattacagccgctttatataagctcgttcactgtcctcattacattcctaatatgcaagtgagcatgttttttaatcctcagtctagaggtgaggaaactgaggcaggcacagagaggctaagggatttgcctagtcgcacagctaggaaggtgcagcactgagactcgaatccacacagcttggcttaagtctaccattaaatttgcctgtcctggccaggtgcggtggctcacgcctgtaatcccaacacttcgtgaggccaaggcaggtggatcacttgaagtgaggagttcgagaccacaccagcctggccaacatggtgaaatcccgtctttactaaaaatacaaaaaattagctgggcgtggtggtgggtgccggtaatcctagctactcaggaggctgaggcaggagaatcacttgaacctgggaggtggaggttgcagtgaaccgagattgcgccactagactccagcctgggagacgagcaaaactgtctcaaaaaaataaaatgaaatacataaataaatgtgcctatcctgtgccgggtgctgttcttgccagtggggatacatgagagaacactgccttgcccgcatgaggcttgtggcctggtactgtgcacacctcaggggattctgataattagctgagcacagttgccagcacagggcctggctcaataaatattagctgctggcttctgctca

SEQ ID NO: 166562 - DNA, 482 bp, Homo sapiens
  Payload ID: 12796
  Gene Symbol: PLEKHG2
  Gene Name: pleckstrin homology domain containing, family G (with RhoGef domain) member 2
  ENST ID: ENST00000438123
  CDS Start-End: 102-482
tggaggggtgtgggaaggcgctggggaggctgtggctgtggggacggcgatcggggttcggagagaccggccggagggggactctgctgggccgctcagccatgcctgagggagcccaaggactgagcctctccaaacctagcccaagcctcgggtgtggccgaagaggtgaagtgtgtgactgtggcaccgtgtgtgagactcggacagcagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggag

SEQ ID NO: 166563 - DNA, 3898 bp, Homo sapiens
  Payload ID: 12796
  Gene Symbol: PLEKHG2
  Gene Name: pleckstrin homology domain containing, family G (with RhoGef domain) member 2
  ENST ID: ENST00000458508
  CDS Start-End: 127-3840
gaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatgg

SEQ ID NO: 166564 - DNA, 871 bp, Homo sapiens
  Payload ID: 12796
  Gene Symbol: PLEKHG2
  Gene Name: pleckstrin homology domain containing, family G (with RhoGef domain) member 2
  ENST ID: ENST00000451354
  CDS Start-End: 276-871
agacaaacgggactcgcagcttctgcgcctcctgctccgctcactcttctttgtctcagcctttccatctttttcgccaggttctctctccttgtccccttctttctgtcactttgtgcctcccccattagttactcccaggggcccctccctggatttacaccacgctcctaattcccagcccccatctgtgagtctgggcggcggagaggcccatggggtcctgatatccaagaaggggctctttctgcaggactctgctgggccgctcagccatgcctgagggagcccaaggactgagcctctccaaacctagcccaagcctcgggtgtggccgaagaggtgaagtgtgtgactgtggcaccgtgtgtgagactcggacagcagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgag

SEQ ID NO: 166565 - DNA, 527 bp, Homo sapiens
  Payload ID: 12796
  Gene Symbol: PLEKHG2
  Gene Name: pleckstrin homology domain containing, family G (with RhoGef domain) member 2
  ENST ID: ENST00000596443
  CDS Start-End: 1-348
tctcctcgacctcgagatgctagaagttttacccctgggcgaaggaacacagctccatctcctgggccctctgtgattcgccgaggccgcaggcagtctgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccaggggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaaggga

SEQ ID NO: 166566 - DNA, 578 bp, Homo sapiens
  Payload ID: 12796
  Gene Symbol: PLEKHG2
  Gene Name: pleckstrin homology domain containing, family G (with RhoGef domain) member 2
  ENST ID: ENST00000596339
  CDS Start-End: 1-462
acacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgtt

SEQ ID NO: 166567 - DNA, 347 bp, Homo sapiens
  Payload ID: 12796
  Gene Symbol: PLEKHG2
  Gene Name: pleckstrin homology domain containing, family G (with RhoGef domain) member 2
  ENST ID: ENST00000594161
  CDS Start-End: 1-125
ggatccccagggcccaggcgacaccctaccacccttgccatgtcacctcccagaccttcagattccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaa

SEQ ID NO: 166568 - DNA, 416 bp, Homo sapiens
  Payload ID: 12796
  Gene Symbol: PLEKHG2
  Gene Name: pleckstrin homology domain containing, family G (with RhoGef domain) member 2
  ENST ID: ENST00000594124
  CDS Start-End: 1-254
ctttacctgagagaggaggctctctagacattcagggcctctcacccaccccagttcagaccaccatggttttgtccaaaccaggaggctccttagcctctcacgttgccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggctgtgggagatgacaagacaatgaatgggaaggtctgacacagaacaaatcagcggttctgaaagcttggggaatctcagactcctttgagaattattggaaaatggacccactataacttgg

SEQ ID NO: 166569 - DNA, 431 bp, Homo sapiens
  Payload ID: 12796
  Gene Symbol: PLEKHG2
  Gene Name: pleckstrin homology domain containing, family G (with RhoGef domain) member 2
  ENST ID: ENST00000595920
  CDS Start-End: 286-431
cctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacaggtgagcctagaggcaggggcggcggagcctgtggggc

SEQ ID NO: 166570 - DNA, 422 bp, Homo sapiens
  Payload ID: 12796
  Gene Symbol: PLEKHG2
  Gene Name: pleckstrin homology domain containing, family G (with RhoGef domain) member 2
  ENST ID: ENST00000598238
  CDS Start-End: 1-287
ggttccagggatgttcagggcccagaccctgtctgcagtcaacccatccagcctttgtcttggcatggaagcagcctggatccccagggcccaggcgacaccctaccacccttgccatgtcacctcccagaccttcagattccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgc

SEQ ID NO: 166571 - DNA, 530 bp, Homo sapiens
  Payload ID: 12796
  Gene Symbol: PLEKHG2
  Gene Name: pleckstrin homology domain containing, family G (with RhoGef domain) member 2
  ENST ID: ENST00000600210
  CDS Start-End: 1-312
gaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcat

SEQ ID NO: 166572 - DNA, 10351 bp, Homo sapiens
  Payload ID: 12797
  Gene Symbol: PLEKHG3
  Gene Name: pleckstrin homology domain containing, family G (with RhoGef domain) member 3
  Uniprot ID: A1L390
  ENST ID: ENST00000247226
  CDS Start-End: 148-3807
ctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtgaccccgtggctgtggccagctgctttgtggaaaggagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgccttttgcgtttctctccggtccccaggaaacatcctagaagacaaggattttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagagaaaaaaaaaaaaagaccttgctagggcactgggagagcttagccctggtgtggcacacacagggtctcccaaagctggatgcctgcattttcagtctagttggtcgaatgtcttggagcctgggtgacaggagggatgtgtggggagctggcaacagaatggtcacatgcagctggctgccctggaccaggccaggggacctggggtggtgagatgctagctcttccactagagcccttcctttctcgggtctgtggagttgcttgctggaaatgcctcacttcaggtgctgatttggcacacgtggaagggggagggtgggcccttgtccctaggctccctaaagactggcccagggaaacagttgagggagatgtttgccaccatctgcccttcagcaaggaacctgctctctgccccagaggaggacatgcctgcaagtgcaccaaaggcctactttattgctaggtgagtgcagtcacctcactgccttggtttccccagatacagaaagaggctggtgagtgatacacactaggttccctgtatagggtcatatgtaccaaagccaaatgaagaccttgctcaccagggcgggaacctggggatgtcaggctccatcggatgacgtcttccttcctgtggctcctgcctgctgcagttggtgtcaccctgacatatagtgtcagggccacagggtggaactgatttctgccggcactggtcagcactcagggttcctcagggggcctcattctggatgcctgcccctgtggcttctacctgaacctcacccacttcatctccatggaactaaggtccttctcacggggaaggtgatagaaacttgactgcaggccctggggactttcatggtttccttgggggaaaatgcctgctgccctccgccctcccccccacccccgacccgcttgactgctctcttggacctaaccctagtttgatactgggccagaactgtgttgctttcggagtagagtggtggggaaaatatggaatgagctttctcttcctccagaagtatgacctgagcagcaaggggaaggccattcctggggacgttggttgcagagcttctggtgctcagggctggagggtggtagatatttgacctctgtactcatgtgaccccctccccgccaagacctggggccaggacgtggagaagctgatcaaggggtaccacaccttcatggctctggccctgacatttgtcccagttgtgcaggagtagctgtcacatgggtggtgataccaagacatggctgcgtctgccaccccgagaaaacagatgatcaactttactgtctgcccagccattaccctccaaagtcccagctgcagacaggatgcaattgagcatttggctttgggatgctttactgcaggtgcggggggtatccatcttatatctgggggcccacactgtcccgtagggggcctatgtctgttggatattgctggtttggctgccactgggagtggggcgagggtcccagcattgagagggagagccttaggcagtgttgtgacgcacctgtcactccttcagatcagagccctgtgccctagccacggttttcaatgaggaatggtctgaccttgctgcccttcctgggaccgcctgtggtggcacaaagggtgctagaggcactcagccaggccctgccaaccgtgggagggtaccctttgatctggggggagaagcagagaggagggatgtggtggcccctgaagtgagagtcccagttctgcggaagcccagtgggaaggaggctggcagctcccaaggccctgcacccagtctggtcccctcagccccccagagcccctggcccagagctagggctttgtgggccacctgaaggctccttcctcatgcccctagggggctggccatgcatttccagtgtcttcttcctttcccctttccctggctgccaccaggtgggaggtgacccgaagcaagacttgctttaggaacgggcagcgtttgaagaaccccatcagccttctccagctcttttttttttttttttttggttgggggtaaggggcctgtgccccctcggctcaggaggagggtgggagaggagggcgtgtgcctcagagaaccgtttcctgcccccaggcctggaggccccaaaggcgccagaggagctgggagcccctgtccctggagcggagccagcgcgggcgagggcatggagggggcgtcggcccaggacacgcgggcgaaggcagcttttgcagtgcagcgtggggcccgggggcccggcccgcgactcgactcatctcgattcgaccggcgggcggcggcgagaggaggccaaggcctgggctgcccggtctctgcgcgtcccgactccgccgcgcccgccagccccacctgctacttctttttggggaagaagctgaatctcttctccttgtctttcttgccgaggctggcgtcggggccggagagggaaggcaggggcaggctctgcgccttgacgcggatgctctgggactcgttgatggcggtgctcacgccctgcagccaggacagcatctcctcctgcggggcggagggtcacggtggagtctggaggcccacagccccccacctcccgggccaggcaacaatggtgggggctcttgggactgccccttctgagggggcctccagggcaagcggcctggggtcctccacctacccccttcttagccaggtctgggctaggctgcccgcgcttacctcatccttgccatggaagagccactcgctgccattactcagcctaggaggacaaagggtttcctgtcatggagacacctctggagggggcgctgggcagagggctggctctgatcccacaataccctgagccgaacatccagacccctctcaggcagcccagcactttctgagaggtcaaagtctggaccatcagcctctttgatttgaaaaacccctgaggagcagctcaggcctggcactggtcccctacagagggcctctgccctgccactaatgccaaatcaagccatcaacccgagctttcaaaggccaggaaggcctcacctcagcttaaagacgtgcttcttcttcttgtagttggcagcaatctcacagatggcatgtctcagggccaggggttcctccccatggtagggcatccccagggccaggttcttggcatccttgtagaaggttagctcactgttcctgagcacacagtacaggttgttccaggacctgcaaagatgcagacaggcaggtcacccacatcctgatatggtatctctagagtcaattcctatagcttcaccattaaaaaaaattacacca

SEQ ID NO: 166573 - DNA, 4397 bp, Homo sapiens
  Payload ID: 12797
  Gene Symbol: PLEKHG3
  Gene Name: pleckstrin homology domain containing, family G (with RhoGef domain) member 3
  Uniprot ID: A1L390
  ENST ID: ENST00000394691
  CDS Start-End: 270-3761
gctcgacttcctgccgggcgctggcaagccgcgcgctgcctggggtctccgggggccgcgcttgcagctggccgagtccgggccagctgaggggctggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggagagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgacc

SEQ ID NO: 166574 - DNA, 635 bp, Homo sapiens
  Payload ID: 12797
  Gene Symbol: PLEKHG3
  Gene Name: pleckstrin homology domain containing, family G (with RhoGef domain) member 3
  ENST ID: ENST00000555982
  CDS Start-End: 70-635
ccatgctgtctcgggaggcggtgatagcagaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtgaccccgtggctgtggccagctgctttgtggaaaggagccaagagtttgatatctacactcagtattgcaacaattaccccaa

SEQ ID NO: 166575 - DNA, 554 bp, Homo sapiens
  Payload ID: 12797
  Gene Symbol: PLEKHG3
  Gene Name: pleckstrin homology domain containing, family G (with RhoGef domain) member 3
  ENST ID: ENST00000554088
  CDS Start-End: 367-554
agtatcccctgtgcttaattgctggaggtttgtgcaggtcctcagccctgtggcgctcacctcccagggctgtggcctgggtccctacccagcggggacctgcagaattgtgtcgggaagttgcatttcctgggctagggccccccagcaatcaggaatgagagaaatgcagaaagtatgacccacacgcagaactggttctgaatagaacatttattgacgaagttttgcaggaggcggcgggcgctttaattcccgaggctgttggtggcagctcgctgctcaccccaagcctgttaactgctaggttgccggtgctggggacaatgcggctgcccggcccctcgccaccctcgtggtgcccggatgggagctctcctgaggaaagcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctc

SEQ ID NO: 166576 - DNA, 3106 bp, Homo sapiens
  Payload ID: 12797
  Gene Symbol: PLEKHG3
  Gene Name: pleckstrin homology domain containing, family G (with RhoGef domain) member 3
  Uniprot ID: A1L390
  ENST ID: ENST00000471182
  CDS Start-End: 208-2466
tttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacc

SEQ ID NO: 166577 - DNA, 3001 bp, Homo sapiens
  Payload ID: 12797
  Gene Symbol: PLEKHG3
  Gene Name: pleckstrin homology domain containing, family G (with RhoGef domain) member 3
  ENST ID: ENST00000484731
  CDS Start-End: 185-2359
cctgacagggcatgaaggcaacgagaagggggctgggccggagcccccaggctcagaggaggaggaggaggagcaggaggagagcctggcggtggcggagcagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaaccca

SEQ ID NO: 166578 - DNA, 658 bp, Homo sapiens
  Payload ID: 12797
  Gene Symbol: PLEKHG3
  Gene Name: pleckstrin homology domain containing, family G (with RhoGef domain) member 3
  ENST ID: ENST00000554499
  CDS Start-End: 174-658
gtgagccatcatgcctggccgagaaagcgagttttctagaagactgattcactgattgatgactgactggattgattcatgttgcaagatggaagaggtcatggctggggcatacttaagagaactggagacccaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtga

SEQ ID NO: 166579 - DNA, 2118 bp, Homo sapiens
  Payload ID: 12797
  Gene Symbol: PLEKHG3
  Gene Name: pleckstrin homology domain containing, family G (with RhoGef domain) member 3
  ENST ID: ENST00000634379
  CDS Start-End: 309-2118
cctcgctccctcctgccctcccgctgcagctccggctccgctcgacttcctgccgggcgctggcaagccgcgcgctgcctggggtctccgggggccgcgcttgcagctggccgagtccgggccagctgaggggctggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggagagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagact

SEQ ID NO: 166580 - DNA, 6782 bp, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENST ID: ENST00000360461
  CDS Start-End: 2536-6111
tggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgt

SEQ ID NO: 166581 - DNA, 4513 bp, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENST ID: ENST00000379344
  CDS Start-End: 273-3848
ggtgtcccgtgacgccgcgcggccgcgctgtagtggccgtcgaggccgccgtctgttcgaaggctgtccgacttcacggttccccgcggctcggcccgggggcgcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactg

SEQ ID NO: 166582 - DNA, 4480 bp, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENST ID: ENST00000450733
  CDS Start-End: 457-3789
gtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacaggggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgc

SEQ ID NO: 166583 - DNA, 4455 bp, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENST ID: ENST00000427155
  CDS Start-End: 209-3784
gttggtcgctgccccaacccacgcactgcgacgccgcgggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgt

SEQ ID NO: 166584 - DNA, 574 bp, Homo sapiens
  Payload ID: 12798
  Gene Symbol: PLEKHG4
  Gene Name: pleckstrin homology domain containing, family G (with RhoGef domain) member 4
  ENST ID: ENST00000562144
  CDS Start-End: 346-574
gtctctgtttccatgaagcctacaatgcacattctctgtggagtggagaaaccagggcccagccctgcctctatctcagtatggctgtacctcccctgaatctgcctgctgtgcccagggtgccaggtgaggagggtgaggctcaaagagcagagttcctggagcgcccccagcaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcag

SEQ ID NO: 166585 - DNA, 698 bp, Homo sapiens
  Payload ID: 12798
  Gene Symbol: PLEKHG4
  Gene Name: pleckstrin homology domain containing, family G (with RhoGef domain) member 4
  ENST ID: ENST00000567136
  CDS Start-End: 1-319
agacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgatctccctccctagctgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtggg

SEQ ID NO: 166586 - DNA, 560 bp, Homo sapiens
  Payload ID: 12798
  Gene Symbol: PLEKHG4
  Gene Name: pleckstrin homology domain containing, family G (with RhoGef domain) member 4
  ENST ID: ENST00000565899
  CDS Start-End: 340-560
atgatgcttcctgaagccaggagggtgggaagagaggtctggctgggagttagggatggagcaggacaactccaaggctcccctctggcagccagacctgctcatgaagaaggctcctcggtgaggagggtgaggctcaaagagcagagttcctggagcgcccccagcaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttaccccc

SEQ ID NO: 166587 - DNA, 491 bp, Homo sapiens
  Payload ID: 12798
  Gene Symbol: PLEKHG4
  Gene Name: pleckstrin homology domain containing, family G (with RhoGef domain) member 4
  ENST ID: ENST00000562744
  CDS Start-End: 300-491
accctcgctcacccacgcggccttcctggcgggagagcgcttccggcgtcctcgccaggcccggggagtgggcacggtggagctgccgaccgttggtcgctgccccaacccacgcactgcgacgccgcgggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccagggactcgggatgtccaaggccgggcagtgctgcttctgtgtgcccacagccca

SEQ ID NO: 166588 - DNA, 466 bp, Homo sapiens
  Payload ID: 12798
  Gene Symbol: PLEKHG4
  Gene Name: pleckstrin homology domain containing, family G (with RhoGef domain) member 4
  ENST ID: ENST00000567938
  CDS Start-End: 236-466
ttcacggttccccgcggctcggcccgggggcgtgagtgtcgccagcgggcgacgggggggcgcgcggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagat

SEQ ID NO: 166589 - DNA, 542 bp, Homo sapiens
  Payload ID: 12798
  Gene Symbol: PLEKHG4
  Gene Name: pleckstrin homology domain containing, family G (with RhoGef domain) member 4
  ENST ID: ENST00000565773
  CDS Start-End: 219-542
aaccccacctcagcaccagcctcctgcaccggactttgtggagaagggggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgcccc

SEQ ID NO: 166590 - DNA, 514 bp, Homo sapiens
  Payload ID: 12798
  Gene Symbol: PLEKHG4
  Gene Name: pleckstrin homology domain containing, family G (with RhoGef domain) member 4
  ENST ID: ENST00000568621
  CDS Start-End: 407-514
gtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaa

SEQ ID NO: 166591 - DNA, 6949 bp, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENST ID: ENST00000563969
  CDS Start-End: 2536-3117
tggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcaggtaaggaaggctgggctagggaagtctgggaagggaatggggatgcctggagagatgagtgtcaagactttggaggtctctgaccctactcaggctgaagcccgggtccaagtaggggtctctggataggtggtccaaggcagacccaagtcatttcccttcccaagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgt

SEQ ID NO: 166592 - DNA, 2182 bp, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENST ID: ENST00000393966
  CDS Start-End: 150-731
gccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcaggtaaggaaggctgggctagggaagtctgggaagggaatggggatgcctggagagatgagtgtcaagactttggaggtctctgaccctactcaggctgaagcccgggtccaagtaggggtctctggataggtggtccaaggcagacccaagtcatttcccttcccaagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcttattgccctcaatcacaggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagct

SEQ ID NO: 166593 - DNA, 489 bp, Homo sapiens
  Payload ID: 12798
  Gene Symbol: PLEKHG4
  Gene Name: pleckstrin homology domain containing, family G (with RhoGef domain) member 4
  ENST ID: ENST00000569875
  CDS Start-End: 1-378
gtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgagtctgagcccgggactggacgagcagtagatccagcagcctgcagctccaaggaacattgcctctctggatctgctgtgaccagggtgtggctgacacctgggctacctccaacctacatgtgcaacgctgttgactacc

SEQ ID NO: 166594 - DNA, 11513 bp, Homo sapiens
  Payload ID: 12799
  Gene Symbol: PLEKHG4B
  Gene Name: pleckstrin homology domain containing, family G (with RhoGef domain) member 4B
  Uniprot ID: Q96PX9
  ENST ID: ENST00000283426
  CDS Start-End: 51-3866
cgggggaccccacttgtgtgcagcctagacgctggttcagggagtcgtacatggaagccttgcggaaccccatgcccctgggcagctctgaggaggccctcggggacctggcctgcagctccctgactggagccagcagggacctggggactggggcagtagccagtgggacccaggaggaaacctctggcccccggggagacccccaacagaccccaagtctagagaaggagaggcacacacccagccggacaggtccaggagctgcagggcggactcttcccaggagatctcggtcctgggaaagggcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcagaacaacacatctcctataattcatagtatcttgctgttggtagataaagaatctgcatttaggcctgacaaggatgcaataattcagtgtgaggtcgtgagctccctgaaggccgtgcacaaatttgttgacagctgccagctgaccgcagacctcgacggctcctttccctacagccatggtgactggatctgcttccgtcagaggctggaacacttcgctgcaaactgtgaagaagccatcattttcctacagaattcattctgctccctgaacacccacagaaccccaagaacagcccaggaagtcgccgagttaattgaccagcatgagacgatgatgaagcttgtcctggaagacccactgcttgtgtctctcaggctggaggggggcaccgtcctggcgcggctgaggagagaagagcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccagcaatcctgccagaaaggactacagctggcgaaggagaacccgcaacgtacagaggaaatggtccaggatttcagaaggggcctgagcgccgtggtcagccaggctgagtgcagggagggagagctggccaggtggacccgctcgtccgagttgtgcgagacggtgagcagctggatggggcccctggacccggaggcttgtccctcctcacccgtggctgagtgtttgaggagctgtcaccaggaggctacctcggtggctgcagaggccttccccggggcaggtgtggcagtgctgaagcctcatgccctggggaaaccgtgggcatcacagcaagacctgtggctgcagtacccccagacccggctccgtctggaagaggccctttctgaggctgccccagaccccagcttaccgccccttgcccagagccccccaaagcatgagcgtgcccaggaggccatgaggaggcaccagaagccaccctcattccccagcacggacagtgggggtggtgcctgggaacctgcgcaaccactgtccggcctccctggacgagcgcttctgtgtggacaggacggggagaccctgcgcccagggctgtgtgctctgtgggacccactgtccctcctcaggggccttccaggggcaggggccaccacggcccacctggaggacagctctgcctgttcctctgagcccacccagaccctggccagccgccccaggaaacatccccagaagaaaatgataaagaaaacgcaaagtttcgagatacctcagcccgacagtggccccagggactcctgccagccagaccatactagtgtcttcagcaagggcctggaggtaaccagcactgtagccacagagaagaagctcccgctgtggcagcatgccaggagccccccggtcactcagagccggagtctgtcctccccctcggggctccaccctgctgaggaggatgggaggcagcaggtgggcagcagccgactgaggcacatcatggccgagatgatcgccacagagagggagtacattcggtgcttaggatacgtcattgacaactattttccagaaatggaaagaatggacttgccccagggccttcgagggaagcaccacgttattttcggcaacttggagaagctccacgacttccaccagcagcacttcctccgggagctggagcgctgccagcactgccccttggccgtgggccgcagtttcctgagacacgaagagcagtttgggatgtacgtgatctacagcaaaaacaagccgcagtcggatgccctgctcagcagccatggcaacgccttcttcaaggacaagcagcgggagctaggtgacaaaatggacctggcctcctacctgctgcggcccgtgcagcgtgtggccaagtacgcgctgctactccaggacctgctcaaggaggccagctgtggcctggcccaggggcaggagctgggcgagctccgagccgccgaggtcgtggtctgcttccagctgcgtcacggcaatgacctgctggccatggacgccatccgcggctgtgacgtgaatttgaaggaacaggggcagctgagatgccgggatgagtttatcgtttgctgcgggaggaagaagtatctgaggcatgtgttcctctttgaagacctcatcctgtttagcaagacccagaaggtggagggcagccacgacgtctacctgtacaagcagtccttcaagacggccgagatcgggatgacagagaacgtcggggacagtggcttgaggtttgagatttggtttcgcaggcggcggaaatctcaggacacctacattctccaagcaagctcggcagaggtcaagagtgcatggaccgatgtcatagggaggatcctgtggcggcaggcactaaagagcagagaactcagaatccaagaaatggcatccatgggtataggcaaccagccattcatggatgtcaagcccagagaccggacccctgactgtgcagtgataagcgaccgggctcccaaatgtgcagtgatgagcgaccgagtccccgacagcatcgtcaagggcacagagtcacaaatgagagggtccacagcggtgtcctcctctgaccacgccgcccccttcaagcgaccacactccaccatctcagacagcagcacctcctcttctagcagccagtcctcctccatcctggggtcgctgggcctgcttgtgtcctccagcccagcccacccgggcctatggagccctgcccacagcccctggtcatctgatatcagagcctgcgtcgaggaagatgagccagagccagaactagagacgggcacccaggctgcagtgtgtgagggggctcctgctgtgctgctgagccgcacacgccaggcctgatgactgtcagggtggcagtgcccatcatgtggctagaacaatacagagggagcagcacgccaggcctgatgactctgggggtggcggtgcccatcgcgtggctggaacgatccagagggaatagcacagcaggtgtccaggtatttcccaggattttagacattccctaacattttcaaacaaatttataattttgtcttatttaaaaaacaaaccttccacttccacccaagacaacagcataggaaacagacctaaaacaagacaaaaaaagactaaacatgaaacaaaagatgtcaagacacaagacatttggcaacaaaggaccgcgatccctgagagacaggaaaacgggaggtgagcccggtgatggcctcagacctccctccgccttgagagtttgcaggcctcagtgcagggaggggcccaggaagagcccagcagcctccgtgagttgaagagaccaagtcagcaggagttggcaggtcagagtgccagagagagatgcctgcatggggaaagactcaccagatcagcccctccagcacctagtgggttgctacccattcgcacactcaaacagggaggctaccaaggctgggagcaacctttgaaaagaccaaagatcaattcctggtactcatgtgggctggggacaggacccgttcccaccagccagactagggaaactctcaatagatcaattcctgatactcatgtgggctggggacaggacccactcccaccagccagactaggaaaactcccaatctgtgagcattaggtggagttctcagaaaatcttgcctcaggaatggggataattagccctagactgagccctgctcctgactcgcctacaaaatcataaaagcaagacctaaaatgatcaaaccattcccagataattcactttatcccagaacaaagctccagatgatctaggggttaccaaagtgtccacaccctgcaaggtaaactcacagtgcctgacctcggagtgccaggcgtgcagaggagcagccaagggcaaacactccaaggagagtcgcctggcaaagccaaccacccagagccagcgtctgtgctagaatcacagaattcaaactgtggctgaaatcgcagcccaggcgtccagaaagttaaagttaagaacctataatcccagcactttgggaggccgaggcaggcggatcacgaggtcaggagatcaagaccatcctggctaacatggtgaaaccccgcctactaaaaatacaaaaaattagccgggcatggtgttggccgcctgtagtcccagctacttgggaggctgaggcaggagaatggcatgaacccgggaggcggagtttgcagtgagctgagatcacgccactgcactccagcctgggcgacagagcaagactctgtctcacaaaaaaggttaagaaatgacttaatggaagagattcagaagacccagaccgaccttacagggatgagaaactacaatattgacagtggaaactatcctggatggggtaacagattggatttcacagaagagaccatgaggcaccttgaagacacatcagtggaaactatttgcatttgttgggcctccagagagacagaaccaataggagatagctagatatatatacagacagatagatagatagatagatcgatagatagatagatagatagatagatagatagatagactgacagacagatgagaggggccttaggggcattggctgacacaattttggcaggtcaagagccccacaataggccatccacaagctggagacccaaggaagctgctagtgtgcccagtccgagtcctaaagcctcagagccagggaagccagtggtgtaattctcagaggccaaaggcctgagaacctgggggccactggtataagtctgagtccatagacccagtgaactccaaacacaagagatacgagtgcacatcataatcaaattgcatataaccagtgataaacagaaaatcctaaaaccagtcagaggacaagggcatgttctgttgggaggcacaaagctgatgaggatggctgactcctcaggagcagcatgggtgagaggcagtggaatgtactaaggagaaaactgccaaattcacattctgtacctgacaaaatctttccgaagcgatggtgacataaagacattttcatacacacagaaactaagagtttcatccccagcagacctgcactacaagaaatgttaaatgatgtgcttcagggaaaagaaaaatgaagagcatgtgcaccatccaggattttcctcgttatttaaatccctttagcccatctcccatttgccccaaggaatgagtgctggcagtgagctgcactttttttttctctaaacgggaaatgggttaaaagatgagtggcttggccgggtgcggtggctcatgtctctaatcccagcactttgggaggctgaggccagaggatcacttgacttgagcccaggaactggggggtcatgctgggaaacatggcaagaccgcatctctattaaaaataaataaaagttaactgactgtttaaacaaaagtattaacgtatctgcggtttgtactatacgcacaggtaaactgtgtgaccacagcagcgtgatggctgggagacgctggatgtgatacgtgaagtgaggggtatcacttgaaggtagattgtggtaagctaaagatgtactgataaacccttgaaacacccactaacaaagaattacagctaatagaccaacagaggagataaaatggaatttttaaaaatccagtccaaaaatacgtagagaaagagggaaagggaagaatggacttgggggcgacacagaagacaagtggagagagactgaagcagccactggccatcacagcaaacacaagcagggcgcaggacgccggcaagccacagacaggcctgctctctgaattggtgaccacatgagtaacttcacgggtctgttctatgtccagagttgtcaaactgcatgctttaaagatgtgcagtggatcgtatgtcgcttaaatcccaacaaagcagtatttttttaaagtacaatcatgcacacagcacttcccctgggaggcaggggctgtgcccacagaagtcgttacctctgcgtcctgagtatggacagccaccatcacacagccccagaggccgcccaggctctagccacactctggcactgcctgggacaggtgccctcaggaacccaaatgccactgcccccgtgaaagccacttcaagcgtgttgcttcaaatcagaaggcatctacgcctgtggaagaggaggctgctgggggcccaggtgtgcagggggcagggccaggtgcaggggcacagcttatgcctgtggccaacccactggggagcaaggctggggatatgcccaggccagcagggccagcaggagtgactgcgccatcctgaacacgtccttgggcctcccaggaccttggtgcctcccatctgggctggcacaagcctccagtcaaaagatgggtctctctctcctgatagcatggagcctggatgtgggaatggagccacaccagccccacgggagccccacgacccatcgggctgtgggatgcatccccacggccgggacccctcagcctgtgacttggtctgggcagatgcaaaggccaccctgcagggctgaggtgtctgtggggaaggaggtgcccagccctgggaggccatcttgctcctgctttttatttaacccatggggctctttggcctcattttctgttttttgagtttctcgtgcactccaaactgtcctggagccagccctggtgtgaaacagaggcttcctgctggcagaagaggcccaccgagttacgtccacaccagctggccctgggcacctctctctctggccttctgtccacactgggatttggctctgatttccagaaggcagggttaggaaacacctgtttccaggcagagtaatgcttctgtctgaatcaggcctcatgggcttcaccagcagacacgaaggtttcatttagatggcgaacacgtgttctcatttctccagggttctggacccgtgagctgaagcaggtgctgagaagtgggagaggcggccactgggtccctcagggtcactcaccccgccacgtgaggccacttccgcccagcactgggggcgctgggagctgaggggcccacaggggacgtgggagacagccccgatgcgtccccatccgcagtgacgctagcgcggagtcgtcgccaagcacgtggagggacagccctggagccctggcctggcccagcatctcccagagtcacttcctgatgcctccccagccctgcccaggaagggtttgtggccacagccccacagcggccccctcgcctcgaccaccagtgcctccttccaagctgcctgagcaatcctgggtggtgagctccaccactcccacccacgcctcagcactgggaccccccagggatggtgtggggattcctgccccccgtccatgcctcagcactgggagctgggaaggtgtgtgatttcctcccccacctcagtactgggacccccaggaagggtgtgtggccccaccatcctgaatgctcagggctggtggtcagcgaggtggtttctaaaccaagccctgggaggagccatcctgggactgtgcttggacaaggttggggctcccgcagtgagctctagccctccccaggaccctcccacggccccagggtgccggccttcagattgaccccattcgtggatgagtctacaaggctccccagtgcccagcaagagtgtttttacattcagaggtgaggaaggggtgccggcatctgccccagacacaaccgggcaggtacagatgtcatccccttgaggacagcagggaggcgactcaggagaggctgatcagacgggagccgcatccccatcaccttccagagagacctcttcttttgccaggtgtcgtgagggctgtggcttagctgggcctgcgtccatccccggttctggggagatgcccgggcccctcctggatggcagcagcagtggaggtttgggttttgagggagccctaagaacctgagagacttagatggagcatggcacgccctggagagtccacgtccccagacccctcatgccaacaccattccacccagcagtttcttccctgtggtcagaacaaaacccccaagcctcaggcctcaggctggttttctgacaggcaaaatgctccttacataaggaaagacctttccttggctgaccctaaagtagccaaggggagctcacatcgcctggcctgccgccaccaccaggctgcctgaccagctcaccgccttgttctagatgcttctgaagcaacagctcgcctggccccacccccatcaagcatctgctgggcagcctccctccccggcccgcctgtagctcccaaaggtctcaagcctcaacatcctggtaaccaagtgcacccagagggctggcagggtcacatggaggcaggggacccttggccccagggtggtcgtcttcccaggaggtccgcctgtcaggtcagagggcagcaggaggccaccccacctccccgggttccctcgagcattcctttgtcaggagcagctcccccaggatccaggcatccctggcccccctttgcccccgccctgctctcaggagccccctgccaggtgctctgaccacaggaaacaggagccctcagggccactgccagaggacggattctgctgccaaccagaggtcctggggctggcggcgctggtgtgcctgccctgggccttcagcagcccccataaggagaaagctccagcctcccgttcagagaaggctccatcctggggacacgcctctcccaaggtcacccacgtgggggctttgttactcatgcttcccagactgcgtgctgtgtcagagttttcacacctgcctgatgtcctgggggggctcacagaggaccgaccctgcagggagatgctgacccaccctgagacccaggagaagaaaacggccagggtccaggctgctcccaccatccctgggggattagcaccttggctgagcccgaactgaccacctggggcgtaggtccaagatttaattacaaaacgataggtgaatgtgggttctgtgtgcctgtgacatagagaatgttttccacaccgcgtgtgaaatgacgagagcttttgtgtcacacatgtagctgctacgagacagacgctcttgttccggatcagagcagcagacagaaccggcacttttagggtccaaaccctgttgcccacagaacgcccatgacaccagctgggtggagctgccgccgagtccacgccccgtctggctgggacctggagctcccctcaagctgcagatccactctgcaccacaaggtggcctcgcagaggagcctcccgagctttggaaccagaggcaggctcagcgatgctctccatccggcctggccccaccgtgtgtatcaggtgtcagaggccttgctgggtgccaggccacgtctgtgctgtcacagctttgaggggccagcgggtcctagggagaggcccgtgcgacgtgagtaacagcagtttttcttctgacagctgggatggaggtgggtcctccagggagtgccccagtcctcgagagccagacttgtgcacgggcctggaaatgaaggtctcaggcaggggctgcgcacaccgatggtcagcattgccgttcggggcctgcagtcgcccataatgggccctgccccctaggcctggcctcttttgctttcctcctggatggttcctctacccctggtccagcagggactcagcagtgcctgccagctgcagacccccatgctcctgcagcctggaaccctcctgccctccaaaggtcatggggtgacccagggtgggaacaccagaccccctcaccccgtgtccaccgcccatggccgggctcacagtgtctcagagccgtggtgagccatcctaggaccagtgtacctcacaacctttcagaccagtgaaggccagtgggctgggtggtccaggcatgtccccaacgcaggtccagccatctctgcacagaactggaatctcggttcatttcggtttcagcaggtcccatgtagttagcaggacagcacttgagttaggtctgagaaagaacgcctgtttgtcatggcatttcctgtaaggagcccagagccgtggccccaggttgggacggcggcgccagagctgggcctgagtctgacccaacctgtgctgagtggtcctgctggaatgggaaccccaagaggaccacccctctctaaaagaagggaaaacagtaagcgagagggaggctgcaggggcccagaccttggctgaccttcctagccatggtctccaccctccgagacccaggggccccgcagtgacagcagggtgttgggccacacagagcccgagtaggtaaaggaaggttctggaaaccacttttcagaacccaaaaggtgtctgggaaatggcgttacctgccactgttgttaagtgtttactttgtatcaatactgaattgttaaaaattttaatcataaaaaccaatggaacatgtttt

SEQ ID NO: 166595 - DNA, 1360 bp, Homo sapiens
  Payload ID: 12799
  Gene Symbol: PLEKHG4B
  Gene Name: pleckstrin homology domain containing, family G (with RhoGef domain) member 4B
  ENST ID: ENST00000502646
  CDS Start-End: 1-1266
gcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcagaacaacacatctcctataattcatagtatcttgctgttggtagataaagaatctgcatttaggcctgacaaggatgcaataattcagtgtgaggtcgtgagctccctgaaggccgtgcacaaatttgttgacagctgccagctgaccgcagacctcgacggctcctttccctacagccatggtgactggatctgcttccgtcagaggctggaacacttcgctgcaaactgtgaagaagccatcattttcctacagaattcattctgctccctgaacacccacagaaccccaagaacagcccaggaagtcgccgagttaattgaccagcatgagacgatgatgaagcttgtcctggaagacccactgcttgtgtctctcaggctggaggggggcaccgtcctggcgcggctgaggagagaagagcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccaggtcagagctgcaggaggaaggcggcccggtcagcatcccctccaggccaggctggccaaggcaaccctctcaccttcacactgtgtctttagggccttgatctgatttccatttggaatgaaattatgtcaggatagggcatgccttgctgcttgtgtaaaaagaaataaattttattttttacgtgagagatactgga

SEQ ID NO: 166596 - DNA, 4715 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000340850
  CDS Start-End: 224-3244
agtttgcgctgagtcgactgagcccgtcccgcggctcccgtccccctctccccgcgcgccccatgaggctttggcagtctcggcccgagccttagagccttagacaccggggaggagaccctggtcctgttcctaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 166597 - DNA, 3475 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000377725
  CDS Start-End: 214-3006
gagtcgactgagcccgtcccgcggctcccgtccccctctccccgcgcgccccatgaggctttggcagtctcggcccgagccttagagccttagacaccggggaggagaccctggtcctgttcctaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 166598 - DNA, 3613 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000377728
  CDS Start-End: 152-3172
agatgaagaccagggagaggaaagggtggacctgaggcccccatggagaagggacgggcaggatgtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 166599 - DNA, 3753 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000377732
  CDS Start-End: 181-3312
ggacgctgacctcttttgaagggaggactgaggagatcaccccacccctcctccggttgggaggccagtggggcccaggggagcctgggtgccccgctgactgatgccctctgctcctcccctgcagacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 166600 - DNA, 3550 bp, Homo sapiens
  Payload ID: 12800
  Gene Symbol: PLEKHG5
  Gene Name: pleckstrin homology domain containing, family G (with RhoGef domain) member 5
  ENST ID: ENST00000377740
  CDS Start-End: 551-3109
cttgatctcccgctgtgaccagcccctctctgcctggcaggggaaagccaccaaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 166601 - DNA, 5221 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000377748
  CDS Start-End: 499-3750
aaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 166602 - DNA, 4698 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000400913
  CDS Start-End: 207-3227
agcattcaaggagctccccaggagaaagagcaagttctgaggagccctctgagcccggcattggtgttgaggagggagtcagagaagagaggggcccggggccgcgcagaggcgcagaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 166603 - DNA, 3697 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000400915
  CDS Start-End: 68-3256
cccagtccccggcgtccccggcgcccccgcccgccgcccgccccccgcgcggcacggggcctgctccatggacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 166604 - DNA, 4794 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000537245
  CDS Start-End: 66-3323
accgcggtgcactccagcccccaggaagagaggcagcttggagggggccaaattcagggtcaaagatgagtcttggggaacgggggtcgccccagaccttcgggggctcctctgtctctaaagggagcgatgcagggcacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 166605 - DNA, 4725 bp, Homo sapiens
  Payload ID: 12800
  Gene Symbol: PLEKHG5
  Gene Name: pleckstrin homology domain containing, family G (with RhoGef domain) member 5
  Uniprot ID: O94827
  ENST ID: ENST00000535355
  CDS Start-End: 27-3254
gcagaccgcggcttcctccggccgccatggggacaggacccggtgtctccggacgcctagcagcctccaggccgggcccggggctgcccctccgggactcggagccctcctgggccgggggtcgtgcccgcgacggtgatagccaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 166606 - DNA, 2881 bp, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENST ID: ENST00000011684
  CDS Start-End: 149-2521
agcgcctcgcgggggtctggcccggagtggagggcgcgcggtcccagccctcccgctcggccggcgggtgtcgagttcagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaatt

SEQ ID NO: 166607 - DNA, 1424 bp, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENST ID: ENST00000304581
  CDS Start-End: 101-1063
aaaagaatgtaggaaggaaggaaggaacgaatgaacatgggagcgcagaggggaggaggagagaggctggggtggattcagtttcagactggacaatctgatgtgccccagagagggaggcagagcctccaccatccatcagaagacagaaaaagcctttggccagctactgtgccagccactgggagagcccaagatacagcatcccctgaaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaatta

SEQ ID NO: 166608 - DNA, 2963 bp, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENST ID: ENST00000396988
  CDS Start-End: 231-2603
ctggcctcccgaaggcgggaggaggggagccgggggctgggctgagacaggaccctgggtagggagcagtgcgagggagacagcgccctcagagggaggactattgggaggcggcaggagggacagcgaacgtttcctcctctgctcctgaatcggaggaagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaatt

SEQ ID NO: 166609 - DNA, 3111 bp, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENST ID: ENST00000449001
  CDS Start-End: 495-2771
atcaaaccccagagctggcgcctcccaggctcccgcctctgcttggcaggagtttgaggccttcctgagatctgcctctccctgagtcaggatgaagatgagcaaaggttcagggtgtccctactcctccagtggtgggtagggacaggagggtgcctgccttggctccacccctggctccacctgcctggctctcctccagtcctaaccaagcagaggggtgtggaagccaggtctgtccctcagcctgcaggtttcccctccaccttgaggacagttctgcttgtggctgggacatcccctgcctcaatgcacgataattttgcctttggagatgggactttcctaggctgtgggtgagaagggagactagaaagtatgtggggtaattcaggccacaggcaaatgaaggaatgtgaccaggcctgccctgggaggagctgtgtggctgtggcttcagcctttcacacagaagggcagccactcccagctggatgggatgcaggctgcacgcccctggggagaaggctgcacatgatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttac

SEQ ID NO: 166610 - DNA, 1683 bp, Homo sapiens
  Payload ID: 12801
  Gene Symbol: PLEKHG6
  Gene Name: pleckstrin homology domain containing, family G (with RhoGef domain) member 6
  ENST ID: ENST00000536531
  CDS Start-End: 180-1667
ggctgggcatcggggctggctggcatcgccggggagccgacggcgacggggagccccgcgggcggggagggcggcgcagggcagcgggtgcggtgacacctgtgggcacagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccagtacgtccttccttcagggagtcttttcttctccctcttctcagcgaggggaaggaggagctgggacggagatcaaataaaggctggcctcttgaa

SEQ ID NO: 166611 - DNA, 3584 bp, Homo sapiens
  Payload ID: 12802
  Gene Symbol: PLEKHG7
  Gene Name: pleckstrin homology domain containing, family G (with RhoGef domain) member 7
  Uniprot ID: Q6ZR37
  ENST ID: ENST00000344636
  CDS Start-End: 185-1324
gaaaattaccagcttcaggggctatgacttctacggtcttaaggataagacctgggatgaagtcttggaaacacatcacaaactcccgaccgatcaattagacctgaaaaagcagcaagaggccgtgtgggaacttttcacaagtgaatgcacctattttttggaccatttattagttcttaagatgatctttatgaatacactaagatatctgcaaactcatgaatatctcctagatgtggatttatggagactttttgcaaacctggaggagttaactcagacaagccttggttttgtgaacagtctctttggcatcatcaaggactatgtagacgcttctgagatttcctcatcactggattttatttccgtgctcacaaagtatttccgagggagtctctgtcagagccaccagacctactgcctgaactattcagctgctatcttttatcttgagagcctgaggcagagagatgactttggaatttatttaaaatggtgtgagcagaatgaacaatgcagacggctccacgtgccagagctgctagtggccccactacagaggctcactcgatatccgttgttgctgaagaatatctggaaaaggagcatggactctgctgagaaaatcatgatctactccatcaaggaaaaggtggaaaagtccatccgggaccttgaaggaaaagtgaagtggctggacaatttccaaaaatttagatatctacaggagattatagtgtggccaccgctttgggatagagataaaaggtttttcattccagagtgtttgaaacacatttttaaagaacacatggcagaaaacatcttgtcaccaaccagcagacaccttctctatgaaggaaaattaactcttgcagaaagcacgagattcctagatgtttatctgtttctcttcaatgatttcctcttagttacgaaaactaagtgcaacaaaaagaaacttggaggctcagaccctggtttaatgtgtccttctcttactcctgagttgcaagcagtaataaaagagggtggttcgtgtacagtactcgatcagcctattccactagatagattggtagtcaaaagtattgaaccactccatgtgtcagtctttgggctgagaaatgcttttcttatacaacacgaaaacagatatcgacagtgtatagcagcattcttattacaagcccaaacggaaaacatcaaaaaaacatggatggcacaaataacaactgcaatttcttgctttaccaagagtcaggaaaccaagaaaatatctttattcacattgcccgcagaatcctctgaaatttagggacctaaaacaagtggcatgtctttttagaagattatggtttaaggtataatttcattcaaagttttgtaacacttagctagtgataagctagaaggaaatttgcattttaaagaagtttcagaatttgaaattttgagctaggaaaatcctcagtatagaggaataatgactgcaacaaatttgaactctgaggaatttcttgacaaatatatactgacatccagattaccttctaatgcttccgtcaggtttgtaagaggtgtgagtgaagaaaggtgctaatttgtaaagggtgaatgatcagataaatggagtatcagaaggaaaacaatgtccactgcttatgtccaatatgaactccagcatcttactctgtatccataaaataatgaaaccaattttccttcatggcctgtcaatcagtcttaaccgctttatagtcctacctcaaacataatgataaatctttagatacaaagcttgattgttcttttaatatacaaagcaataaatagggactacatttaagtagcagttttaaaattcctattctcaaactcatctcaggtatatagtactctaacgtggaagtagaaaatcccaaagactaaattccattactttaagataggaagaaaaaaaaaatctggctttcaccagttaacacttttgcatggcttttcttggcctgttgtgaagtgtacagattttcatagacatagtaaggtatctgtctcttaactttattttttgaagaatgatggtgtttgccataaaaatactttctggttttgattggtgtgtgtgtgtgtgtgtgtgtgtgttagcacagtacagtcacttaattttatttggcaggacttcaaatttcttcagaatttttatcatgaaaggcagtttgaataattattatcatggcaggatatatactattaactacattcaaggaactagttcttagggtcagattattgcatcaaagggaagtccacaaacttccatttcagaatcgtaccttttgcaatttgcaaagtgaaagtagtaaatttatcaaatttggctgcaagacaactgaagccttagctgattttgttaagctgaagaatggggtagagaggataatgtttgggcaagtcatgtgcccagtaattccttgaggaaggtgaaatttcactatgcaaacaaagcagtaaagacaagtgcagcagaaaggcttttgtacaaggcaagcactattagaatggagactaataacctctttataataatgtcagaaatttaatagaagaaaaaaaggaaaatctggaggacagtaactattgttaatagctaagaataaatgaggtggaggggagaaaaaggggagaatagacttcaagcttcaagtgaattcctagagatggcatctggatgggactgaaagcagttatgtccaggagaatacaatatagattatgcaagagaagattttataaagaaatttctggttaaaaaaaatttttacattaacaatcatcttgcaaatgtttagatataaactaacctcggaggtgagcagtggactaggatgaggtggcctctcaaattcctttagtcccatgaatccagcaaccacagacttacatgtataaaggtagttttctccctctgaatctcattaaagggagagacagactgactaaattaacaaaatatataaaacagctcaagaatatgctgtacataaactggaattctataaagctcacaaagtaacatgtctaatatacaatatattagatgtttgaggatatgcacattaaactctttggagggtttagaatgaagcacattcgaatgaagggatcacgggggtcagaacaaaaaccattctagaaccgtggctcccaggaagaaaaaatagcaaaaaacaatggcacattgggccttccaaaaagtatctttggggaggggagggagaaaaataaataaataaataaataaataatgttttaagtatctttaaatggtcatctgggtattaaatgcagacacacaatgaaataaggggttaattacatattttttatatttgtttttagttttgttaattctctacaatattaaatggaatgtctaaggcaaaatggcattaataatttctcttgagatcaggaatttaattactattcgaaattgaacaacattaaaacaccactgtctatatccaagtgcaaagtcctaatattctgtaaataaattaatgcaaaatggttaa

SEQ ID NO: 166612 - DNA, 913 bp, Homo sapiens
  Payload ID: 12802
  Gene Symbol: PLEKHG7
  Gene Name: pleckstrin homology domain containing, family G (with RhoGef domain) member 7
  ENST ID: ENST00000549856
  CDS Start-End: 426-806
tggggcaacgcaactcagggttctacgagcacaggcggagttctgtggtgctgaacttacctggacttgaggtgttccccggggaccttctggtgtcagatggagctgctgattacctatgccatccacttctgctgctgaattcagaatccaaaaagccaagatggcctttctccaaaagaggagtgggcaaagacaaacacaagcacatatctgatctggaaaactgcctgtcctctgtgaaaattaccagcttcaggggctatgacttctacggtcttaaggataagacctgggatgaagtcttggaaacacatcacaaactcccgaccgatcaattagacctgaaaaagcagcaagaggccgtgtgggaacttttcacaagtgaatgcacctattttttggaccatttattagttcttaagatgatctttatgaatacactaagatatctgcaaactcatgaatatctcctagatgtggatttatggagactttttgcaaacctggaggagttaactcagacaagccttggttttgtgaacagtctctttggcatcatcaaggactatgtagacgcttctgagatttcctcatcactggattttatttccgtgctcacaaagtatttccgagggagtctctgtcagagccaccagacctactgcctgaactattcagctgctatcttttatcttgagagcctgaggcagagagatgactttggaatttatttaaaaaaacaaaacgatgcagaggaagaaactgggaacttcgtaccaagtctcttcgtgtggcacaactaacaatggctaagaactctagctgccatggactgagtgtttgagatgtgccaggctctgttctaagcactttgtgagaattatctcattaaaacctctcaccaacctaa

SEQ ID NO: 166613 - DNA, 6604 bp, Homo sapiens
  Payload ID: 12803
  Gene Symbol: PLEKHH1
  Gene Name: pleckstrin homology domain containing, family H (with MyTH4 domain) member 1
  Uniprot ID: Q9ULM0
  ENST ID: ENST00000329153
  CDS Start-End: 133-4227
gggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgaca

SEQ ID NO: 166614 - DNA, 1820 bp, Homo sapiens
  Payload ID: 12803
  Gene Symbol: PLEKHH1
  Gene Name: pleckstrin homology domain containing, family H (with MyTH4 domain) member 1
  ENST ID: ENST00000561370
  CDS Start-End: 1-547
acttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagccccagcatcatgcagtcctcagttgggtgcttacgtgctcttctcttccttgcagcagtcctcaaggcagggcagattcctctttaagagctaaccagagcagaacactgggcctccttttctcagaagggcactgtgcatctgagaggatctccagaccaacaggagcccacaccactgggcctctgaacagcacagttatgattccctttggatattttctcccagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataa

SEQ ID NO: 166615 - DNA, 510 bp, Homo sapiens
  Payload ID: 12803
  Gene Symbol: PLEKHH1
  Gene Name: pleckstrin homology domain containing, family H (with MyTH4 domain) member 1
  ENST ID: ENST00000561057
  CDS Start-End: 1-104
tttttgctgctcagcctgcccagctgtcttccaaggagaacgctctggtgtggattgctgtgaatgaggatggcgtcagcatcctggaccacaacactatgtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtatttta

SEQ ID NO: 166616 - DNA, 747 bp, Homo sapiens
  Payload ID: 12803
  Gene Symbol: PLEKHH1
  Gene Name: pleckstrin homology domain containing, family H (with MyTH4 domain) member 1
  ENST ID: ENST00000559168
  CDS Start-End: 1-244
gcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctaggcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttccccca

SEQ ID NO: 166617 - DNA, 6981 bp, Homo sapiens
  Payload ID: 12804
  Gene Symbol: PLEKHH2
  Gene Name: pleckstrin homology domain containing, family H (with MyTH4 domain) member 2
  Uniprot ID: Q8IVE3
  ENST ID: ENST00000282406
  CDS Start-End: 111-4592
gagctcggcttgaggcgggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgaggccttcaatatggagagtgttaataaaaattctgctgcaaccctttcctatactacatcaggactttatacatctctgatatacaagaacatgaccaccccagtgtatacaactttgaaggggaaggcgacccaaataagtagcagccctttcctggatgactcatctgggtcagaggaagaagacagctccagatccagctcccggacgtcagagtcagactcacgcagtaggagtgggccaggcagccccagagccatgaaacgaggtgtgtctctctcctctgtggcttctgaaagtgattatgctattcctcctgatgcttactccacagacacggagtactcacagccagagcagaagctcccaaaaacttgctcatcttccagtgataatgggaaaaatgaaccactggaaaaatctggttatttattaaaaatgagtggtaaagtcaagtcttggaagcggcggtggtttgttcttaaaggtggtgaattactttactacaaatctccgagtgatgtaattagaaaaccccagggccatattgaacttagtgcatcctgtagtattttaagaggagataacaaacaaacagttcagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtccaacttacctcctaattggatccaagcatgaaaaggacacttggctttatcatctgactgttgcagctggaagcaacaatgtaaacgttggatctgaatttgaacaactggtttgcaaattgctaaatatagacggggagccttcctctcagatatggagacaccccactttgtgtcacagtaaagaaggaatcatttcccctctgacaactctaccttccgaagccctgcagacagaagctattaaattatttaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaaccca

SEQ ID NO: 166618 - DNA, 737 bp, Homo sapiens
  Payload ID: 12804
  Gene Symbol: PLEKHH2
  Gene Name: pleckstrin homology domain containing, family H (with MyTH4 domain) member 2
  ENST ID: ENST00000491692
  CDS Start-End: 45-314
atcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacagacggaatcttgctctgtggcccaggctggagtgcagtggcgcgatcttggcttactgcaacctccgcctcccgggttcaagtgattctcctgcctcaatctcctgaataactgggattacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtt

SEQ ID NO: 166619 - DNA, 632 bp, Homo sapiens
  Payload ID: 12804
  Gene Symbol: PLEKHH2
  Gene Name: pleckstrin homology domain containing, family H (with MyTH4 domain) member 2
  ENST ID: ENST00000490038
  CDS Start-End: 1-267
tccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcacc

SEQ ID NO: 166620 - DNA, 2987 bp, Homo sapiens
  Payload ID: 12805
  Gene Symbol: PLEKHH3
  Gene Name: pleckstrin homology domain containing, family H (with MyTH4 domain) member 3
  ENST ID: ENST00000293349
  CDS Start-End: 432-2804
agtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaa

SEQ ID NO: 166621 - DNA, 1047 bp, Homo sapiens
  Payload ID: 12805
  Gene Symbol: PLEKHH3
  Gene Name: pleckstrin homology domain containing, family H (with MyTH4 domain) member 3
  ENST ID: ENST00000587627
  CDS Start-End: 430-1047
tcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggaggcagtgtggaagaagggaaaatgaggaggagagggtgccttggagcctggcagaacgagctcacctctcctgtttcaaagatggggaaactaaggcccggagacgggaagagacttgcccaaggttccacaggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaag

SEQ ID NO: 166622 - DNA, 2640 bp, Homo sapiens
  Payload ID: 12805
  Gene Symbol: PLEKHH3
  Gene Name: pleckstrin homology domain containing, family H (with MyTH4 domain) member 3
  Uniprot ID: Q7Z736
  ENST ID: ENST00000591196
  CDS Start-End: 71-2188
cgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttacacaaa

SEQ ID NO: 166623 - DNA, 2983 bp, Homo sapiens
  Payload ID: 12805
  Gene Symbol: PLEKHH3
  Gene Name: pleckstrin homology domain containing, family H (with MyTH4 domain) member 3
  Uniprot ID: Q7Z736
  ENST ID: ENST00000591022
  CDS Start-End: 389-2770
cggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttacacaaa

SEQ ID NO: 166624 - DNA, 1206 bp, Homo sapiens
  Payload ID: 12806
  Gene Symbol: PLEKHJ1
  Gene Name: pleckstrin homology domain containing, family J member 1
  Uniprot ID: Q9NW61
  ENST ID: ENST00000326631
  CDS Start-End: 73-522
ggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttcc

SEQ ID NO: 166625 - DNA, 935 bp, Homo sapiens
  Payload ID: 12806
  Gene Symbol: PLEKHJ1
  Gene Name: pleckstrin homology domain containing, family J member 1
  ENST ID: ENST00000586608
  CDS Start-End: 51-503
gggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgaggtaggggcgtcccgggcgcgcgggcgggtcccaggctgggcccctcggaggccgggtgctcactgccccgtcccggcgcccgtgtctcctccagcccgtcggagccctgctgctggagcgctgcagagtcgtccgggaagagcccggcaccttctccatcactacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgc

SEQ ID NO: 166626 - DNA, 937 bp, Homo sapiens
  Payload ID: 12806
  Gene Symbol: PLEKHJ1
  Gene Name: pleckstrin homology domain containing, family J member 1
  ENST ID: ENST00000587394
  CDS Start-End: 25-858
cgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaagaaacaccaagggacccacgacaggcctgccccgcatcgcagggcatgctgcgagccatggacagccgagaaatacaaaagtaaatgcacttgttcaacgtgcccgcgccgtcctcacagcaccatcgcgcagcacatggccagctgcgtcaccgcgcaggccccttcacatgcaagggcgcaacccacgccccggagggtgaacagtctgggggttcacagtgccggggtaaaggtgaagagctcagggcaggcgccagggcgctcaggaaggggctcaggccgcggggaggcctccgaggaatgtggtggcgacgggcctgcctttggtacgggagcagcgcgtcgggggagccggccgggcggcgtttccgagaacggggttcggcgttgtcagcgtctagtcagcaccaagcgggtggaggcaggcgcgggcctggggacgagatagcaccggggcaggctgtggcgaatccgctggcgggcccgccctgcagacacgtgtctttatatagagctctcatatatag

SEQ ID NO: 166627 - DNA, 2251 bp, Homo sapiens
  Payload ID: 12806
  Gene Symbol: PLEKHJ1
  Gene Name: pleckstrin homology domain containing, family J member 1
  Uniprot ID: Q9NW61
  ENST ID: ENST00000589097
  CDS Start-End: 1115-1564
aactaacaggtatagatgagcatacagaagcgttctcggctacaaggaaggcggccgaaaccatttcagccgcgatcccgattcgaccccaacgaatcttggttgtttcttttttattttgtcaaacagggtcttgctctgttgtccaggctggagtgcaacggcacaatcacaactcactgcagcctcgacctcctggactcaagcgatcttcccgcttcagcctccagagtagctgggactacaggcgcgcgtcaccaaccacgcccggctaattttttttttttttttttttgcagtgatggggtctcgctatgttgcccaggctggagtgcagtggtgggatcatggctcactgcagcctcgacattccgagctcaagcgatcctctcgagtagctgggcctacagggaacccccggtccgcgtcggccgccgccctcaaccgcctctactcctcaccagagcccaaggccgcgttatctcctcctcgtttcgccacctccacgacttcgtttggcgaacggcgggcaaagaaagcacttccggggcaaatgagacgggccctctggtgtgcgcatgcctggcccgcccagcggcgtgagtcagagggtcccgaggcgcgaaggaaaaggctggagggggagaggctgaaagcgcggcctggaaggcaaactgcgcgtgcgcacaacgctctcaacgaaccctcggtccgctgcggccgcacggggccaactttcgcgagggagcggctgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 166628 - DNA, 1092 bp, Homo sapiens
  Payload ID: 12806
  Gene Symbol: PLEKHJ1
  Gene Name: pleckstrin homology domain containing, family J member 1
  ENST ID: ENST00000591099
  CDS Start-End: 47-331
cggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcactacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccaca

SEQ ID NO: 166629 - DNA, 1311 bp, Homo sapiens
  Payload ID: 12806
  Gene Symbol: PLEKHJ1
  Gene Name: pleckstrin homology domain containing, family J member 1
  ENST ID: ENST00000587962
  CDS Start-End: 79-603
atttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccacactgg

SEQ ID NO: 166630 - DNA, 5263 bp, Homo sapiens
  Payload ID: 12807
  Gene Symbol: PLEKHM1
  Gene Name: pleckstrin homology domain containing, family M (with RUN domain) member 1
  Uniprot ID: Q9Y4G2
  ENST ID: ENST00000430334
  CDS Start-End: 135-3305
gttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctcatca

SEQ ID NO: 166631 - DNA, 2825 bp, Homo sapiens
  Payload ID: 12807
  Gene Symbol: PLEKHM1
  Gene Name: pleckstrin homology domain containing, family M (with RUN domain) member 1
  ENST ID: ENST00000446609
  CDS Start-End: 173-364
acacaattcaggcagtggagagaaggccgtggggagtggctgaggagtccctcaagagaagaggttgctgttcactgatggtggagtgttttgagagtggtggaaccaggttatccctttcttcttttaacgtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacag

SEQ ID NO: 166632 - DNA, 603 bp, Homo sapiens
  Payload ID: 12807
  Gene Symbol: PLEKHM1
  Gene Name: pleckstrin homology domain containing, family M (with RUN domain) member 1
  ENST ID: ENST00000584420
  CDS Start-End: 182-603
agtggccgagagaccgcatcgtcggctcggaggctgaggggctgccgcggccgggagcgcccctcgcctcgctcctcgctccgcttgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctg

SEQ ID NO: 166633 - DNA, 3292 bp, Homo sapiens
  Payload ID: 12807
  Gene Symbol: PLEKHM1
  Gene Name: pleckstrin homology domain containing, family M (with RUN domain) member 1
  ENST ID: ENST00000581448
  CDS Start-End: 120-1127
gagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaa

SEQ ID NO: 166634 - DNA, 4995 bp, Homo sapiens
  Payload ID: 12807
  Gene Symbol: PLEKHM1
  Gene Name: pleckstrin homology domain containing, family M (with RUN domain) member 1
  ENST ID: ENST00000579197
  CDS Start-End: 119-310
agaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 166635 - DNA, 553 bp, Homo sapiens
  Payload ID: 12807
  Gene Symbol: PLEKHM1
  Gene Name: pleckstrin homology domain containing, family M (with RUN domain) member 1
  ENST ID: ENST00000586084
  CDS Start-End: 132-431
gtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaagtgagatttagctggagaggttttgctttgcggaggagcagcagactatgggacacttggcttttcctccccagctgttcaggaagccaacagagacacatcatctcagagttggagcacctgacg

SEQ ID NO: 166636 - DNA, 327 bp, Homo sapiens
  Payload ID: 12807
  Gene Symbol: PLEKHM1
  Gene Name: pleckstrin homology domain containing, family M (with RUN domain) member 1
  ENST ID: ENST00000590991
  CDS Start-End: 1-138
ctgtgccggagtggcgccctgaaggagctcagcaagaggctcaaccacaggaattatctcttggaatctccgcataggttcagtgttgctgacctccaacaggtaagagtgtcatgcttcccccgcccagacctctagagagacttcattcccagagaagtcagcaaggaagatggaagagggggtgtctgtagtttactgaagaagacagcagtctgtagcttttctgcagctcaggatcgcagacggggtgtatgaaggattcctcaaggccctgattgaatttgcctcccagcatgtctaccactgcgacctgtgcacccagcg

SEQ ID NO: 166637 - DNA, 587 bp, Homo sapiens
  Payload ID: 12807
  Gene Symbol: PLEKHM1
  Gene Name: pleckstrin homology domain containing, family M (with RUN domain) member 1
  ENST ID: ENST00000589780
  CDS Start-End: 132-587
gtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatct

SEQ ID NO: 166638 - DNA, 650 bp, Homo sapiens
  Payload ID: 12807
  Gene Symbol: PLEKHM1
  Gene Name: pleckstrin homology domain containing, family M (with RUN domain) member 1
  ENST ID: ENST00000591580
  CDS Start-End: 1-341
tgaagctcctgggggattacctgggcctgtgccggagtggcgccctgaaggagctcagcaagaggctcaaccacaggaattatctcttggaatctccgcataggttcagtgttgctgacctccaacagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttaggg

SEQ ID NO: 166639 - DNA, 5263 bp, Homo sapiens
  Payload ID: 12807
  Gene Symbol: PLEKHM1
  Gene Name: pleckstrin homology domain containing, family M (with RUN domain) member 1
  Uniprot ID: Q9Y4G2
  ENST ID: ENST00000613787
  CDS Start-End: 135-3305
gttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaggtattgttggaattcagcaaagcccaggtaaactctgtgccaaccaacggactgagccaagaaacggagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcactcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttcggcctgtgaggattctccccgaaggtgccctcggaggcagcaggtttgaggccctggggggcccgttccccagaagctgccagtgctttcagatgcattgactcttcccacctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctcatca

SEQ ID NO: 166640 - DNA, 5263 bp, Homo sapiens; identical to SEQ ID NO: 166630
  Payload ID: 12807
  Gene Symbol: PLEKHM1
  Gene Name: pleckstrin homology domain containing, family M (with RUN domain) member 1
  Uniprot ID: Q9Y4G2
  ENST ID: ENST00000617688
  CDS Start-End: 135-3305

SEQ ID NO: 166641 - DNA, 650 bp, Homo sapiens
  Payload ID: 12807
  Gene Symbol: PLEKHM1
  Gene Name: pleckstrin homology domain containing, family M (with RUN domain) member 1
  ENST ID: ENST00000631322
  CDS Start-End: 1-341
tgaagctcctgggggattacctgggcctgtgccggagtggcgccctgaaggagctcagcaagaggctcaaccacaggaattatctcttggaatctccgcataggttcagtgttgctgacctccaacagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttaggg

SEQ ID NO: 166642 - DNA, 2847 bp, Homo sapiens
  Payload ID: 12807
  Gene Symbol: PLEKHM1
  Gene Name: pleckstrin homology domain containing, family M (with RUN domain) member 1
  ENST ID: ENST00000628145
  CDS Start-End: 173-364
acacaattcaggcagtggagagaaggccgtggggagtggctgaggagtccctcaagagaagaggttgctgttcactgatggtggagtgttttgagagtggtggaaccaggttatccctttcttcttttaacgtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaggtattgttggaattcagcaaagcccaggtaaactctgtgccaaccaacggactgagccaagaaacggagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaag

SEQ ID NO: 166643 - DNA, 4995 bp, Homo sapiens
  Payload ID: 12807
  Gene Symbol: PLEKHM1
  Gene Name: pleckstrin homology domain containing, family M (with RUN domain) member 1
  ENST ID: ENST00000628743
  CDS Start-End: 119-310
agaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaggtattgttggaattcagcaaagcccaggtaaactctgtgccaaccaacggactgagccaagaaacggagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcactcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttcggcctgtgaggattctccccgaaggtgccctcggaggcagcaggtttgaggccctggggggcccgttccccagaagctgccagtgctttcagatgcattgactcttcccacctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 166644 - DNA, 603 bp, Homo sapiens
  Payload ID: 12807
  Gene Symbol: PLEKHM1
  Gene Name: pleckstrin homology domain containing, family M (with RUN domain) member 1
  ENST ID: ENST00000629244
  CDS Start-End: 182-603
agtggccgagagaccgcatcgtcggctcggaggctgaggggctgccgcggccgggagcgcccctcgcctcgctcctcgctccgcttgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctg

SEQ ID NO: 166645 - DNA, 587 bp, Homo sapiens
  Payload ID: 12807
  Gene Symbol: PLEKHM1
  Gene Name: pleckstrin homology domain containing, family M (with RUN domain) member 1
  ENST ID: ENST00000629153
  CDS Start-End: 132-587
gtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatct

SEQ ID NO: 166646 - DNA, 327 bp, Homo sapiens; identical to SEQ ID NO: 166636
  Payload ID: 12807
  Gene Symbol: PLEKHM1
  Gene Name: pleckstrin homology domain containing, family M (with RUN domain) member 1
  ENST ID: ENST00000627693
  CDS Start-End: 1-138

SEQ ID NO: 166647 - DNA, 553 bp, Homo sapiens
  Payload ID: 12807
  Gene Symbol: PLEKHM1
  Gene Name: pleckstrin homology domain containing, family M (with RUN domain) member 1
  ENST ID: ENST00000626666
  CDS Start-End: 132-431
gtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaagtgagatttagccggagaggttttgctttgcggaggagcagcagactatgggacacttggcttttcctccccagctgttcaggaagccaacagagacacatcatctcagagttggagcacctgacg

SEQ ID NO: 166648 - DNA, 3292 bp, Homo sapiens
  Payload ID: 12807
  Gene Symbol: PLEKHM1
  Gene Name: pleckstrin homology domain containing, family M (with RUN domain) member 1
  ENST ID: ENST00000630038
  CDS Start-End: 120-1127
gagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttagggctgcccaaacactgtggaaaggggacttggggagcattttcaattccacattcctgattaaaaggtctagttttttaa

SEQ ID NO: 166649 - DNA, 2825 bp, Homo sapiens; identical to SEQ ID NO: 166631
  Payload ID: 12807
  Gene Symbol: PLEKHM1
  Gene Name: pleckstrin homology domain containing, family M (with RUN domain) member 1
  ENST ID: ENST00000631629
  CDS Start-End: 173-364

SEQ ID NO: 166650 - DNA, 587 bp, Homo sapiens; identical to SEQ ID NO: 166637
  Payload ID: 12807
  Gene Symbol: PLEKHM1
  Gene Name: pleckstrin homology domain containing, family M (with RUN domain) member 1
  ENST ID: ENST00000632050
  CDS Start-End: 132-587

SEQ ID NO: 166651 - DNA, 603 bp, Homo sapiens; identical to SEQ ID NO: 166632
  Payload ID: 12807
  Gene Symbol: PLEKHM1
  Gene Name: pleckstrin homology domain containing, family M (with RUN domain) member 1
  ENST ID: ENST00000633460
  CDS Start-End: 182-603

SEQ ID NO: 166652 - DNA, 553 bp, Homo sapiens; identical to SEQ ID NO: 166635
  Payload ID: 12807
  Gene Symbol: PLEKHM1
  Gene Name: pleckstrin homology domain containing, family M (with RUN domain) member 1
  ENST ID: ENST00000633998
  CDS Start-End: 132-431

SEQ ID NO: 166653 - DNA, 4995 bp, Homo sapiens; identical to SEQ ID NO: 166634
  Payload ID: 12807
  Gene Symbol: PLEKHM1
  Gene Name: pleckstrin homology domain containing, family M (with RUN domain) member 1
  ENST ID: ENST00000631843
  CDS Start-End: 119-310

SEQ ID NO: 166654 - DNA, 650 bp, Homo sapiens; identical to SEQ ID NO: 166638
  Payload ID: 12807
  Gene Symbol: PLEKHM1
  Gene Name: pleckstrin homology domain containing, family M (with RUN domain) member 1
  ENST ID: ENST00000633029
  CDS Start-End: 1-341

SEQ ID NO: 166655 - DNA, 3292 bp, Homo sapiens; identical to SEQ ID NO: 166633
  Payload ID: 12807
  Gene Symbol: PLEKHM1
  Gene Name: pleckstrin homology domain containing, family M (with RUN domain) member 1
  ENST ID: ENST00000633444
  CDS Start-End: 120-1127

SEQ ID NO: 166656 - DNA, 327 bp, Homo sapiens; identical to SEQ ID NO: 166636
  Payload ID: 12807
  Gene Symbol: PLEKHM1
  Gene Name: pleckstrin homology domain containing, family M (with RUN domain) member 1
  ENST ID: ENST00000633981
  CDS Start-End: 1-138

SEQ ID NO: 166657 - DNA, 4004 bp, Homo sapiens
  Payload ID: 12808
  Gene Symbol: PLEKHM2
  Gene Name: pleckstrin homology domain containing, family M (with RUN domain) member 2
  ENST ID: ENST00000375793
  CDS Start-End: 170-3169
aggcgaggcgagggccgggcggcgggcgccgggccccgcggccggcacgacggagcccccgtacggccggcggcagcggttggcggcggcccccggcccccggcgcgggaagcggcggcggggcggcggcggcggtggcggtggcggtggcggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaa

SEQ ID NO: 166658 - DNA, 4122 bp, Homo sapiens
  Payload ID: 12808
  Gene Symbol: PLEKHM2
  Gene Name: pleckstrin homology domain containing, family M (with RUN domain) member 2
  Uniprot ID: Q8IWE5
  ENST ID: ENST00000375799
  CDS Start-End: 228-3287
gcctccttccccgccggccgcgctccggagcctccgggccgcggtggagcgagggcccaggcgaggcgagggccgggcggcgggcgccgggccccgcggccggcacgacggagcccccgtacggccggcggcagcggttggcggcggcccccggcccccggcgcgggaagcggcggcggggcggcggcggcggtggcggtggcggtggcggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaa

SEQ ID NO: 166659 - DNA, 1915 bp, Homo sapiens
  Payload ID: 12809
  Gene Symbol: PLEKHM3
  Gene Name: pleckstrin homology domain containing, family M, member 3
  ENST ID: ENST00000447645
  CDS Start-End: 1-1408
gaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggccgccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcaggtaatagagggaaagctggctccattcttgggcaaggtcattaaatttgccacctcacacgtgtacagctgcagtctttgtagccagaaggggttcatctgtgaaatctgtaacaatggagagatcctctacccttttgaggatatttcaacaagcagattcggagacccatatgcagatttattacaaggatatgtggcctgatgctgagatggagtttcactcttgttggccaggctggggtgcaatggcgcgacctcagctcactgcaacctctgcctcctgggttcaagcgattctcctgtctcagcctccggtgtatctgggattacaggcacccaccaccatgccccactagtttttttgtgtttttagtagagactgggtttcatcatgttggccaggctggtgtcaaactcctaacctcaggtgatcctcccccgcctcggcctcccagagtgctgggattacaggcgtgagccactgcacccagcctcaaacacaaattaaatacatacctctctttaacctaaatagaaaaaccgtaaagcccagattgcaagatttttaaatacaataagaatatcctgaattataaaactgctttgctaaagcctaatccaggatttatcctcctagaggactacaaggaaagcacagccttgggagagataaacattttgacaaaacaatgataaaattccacatcct

SEQ ID NO: 166660 - DNA, 3689 bp, Homo sapiens
  Payload ID: 12809
  Gene Symbol: PLEKHM3
  Gene Name: pleckstrin homology domain containing, family M, member 3
  ENST ID: ENST00000457206
  CDS Start-End: 429-2447
gcccgggcgggctgtcaccgtgaggcgggcggcaggctgcgggagtcaagcccctccaggagcggactgaaggccccgcaggtgaatggagagtagcagccggggcccaggaaatcaaggattggcgtggcattgctttgacaagtacttgctgttgtcttcacagaggtctcactgaagaataatctcaaaggaacatttggtctccctatacatctgttaatgcccattagccactagcaaatgcttttaattaccaggaaaacatcaaccactttgggtttggcctgctccagggagcccaatgaaggtttcttccagttgtttccatagctctattgctgaagcacccctcttggttgggtgaatgttcatgaagccatttctggaaccagcttaggaggctaaggcctcctggagcctgtgacatggaagctttggaagtggatgatatcagcccagccttagaagttacggaggaattctttagtactttggatagtaatctagaaaaggctgtgcagcaggcagaggtttatgggatccaggaagtccctgaactggtggggcatgaggtactcagtaacataacagacaatggtgctatgagaaatgtcacctccctgggcaaggggggcatgatttgggaccactgtaagagcaggctcttagaaaccaaagctcaaaatgtcttccctgccaaagaacagtttatggtccagagagggacaaccccagataatctttcctggatggaacaaaaggaagcatcaacctttaatttcttcaatatctgtcagcgtcggagggaccggcctcgttctgtaaatgacttactggatgagacctcaactttcaagccagggcatgctcgatcacgatcagatattacccaagtggactggagggtagtcctcaaaaccacgcctttgcagcagcagcaacagcagcagccattgcttcaaggcccgcatgtcaccaggccatcttttctgttgccctcaccaaataagatagaagatgctcaaggaaatactgaacacaagcagacattcccaaacattctaaagaagggttacctggagattagaaaggaccatgacagttactggcaaagctgttatgcagaactttcaccttacaacttatacttctacagcctcgacagcagtgggaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggccgccgtgctgcggctgcggcagcggctgaagtcgctccgagcctatttgttcagctgccgggcagcggtggcagaggatctccgccgcagaaatgaccagcagcatgcattagtcatgttaaatgtttttggagaattttccccagagaatacctccttcaacagatccacctgtattcacttgccgacctgcagcagacccaggcactacagccaaatctaacctgatccacagatgattgaaggatcgggggagctcggcacgggatgtggcagcaaatgtgcggcactaaggacaaagtcactgccttttgtggaagccagatcagaaagatgactgtgtgttgtgagtggtggatagagagccctgttgcccaggtgagaaggagctcagttgagataaggattccaggagccaactcgagcccctcaggtagagacaacaataccggttgaggctgcagctgtggagttggatggtgtttagtcagtgctgaaatcactttcctgggagtcccttggcatgcagtcatctgagtgctgttgttgttgttgggtttttgttgtttcctattttaaaagagtaatcataatactgacgaagtgagggcctgttttcaaagaacatttacttaaagatatagagtaaggttagcatcggtcttgccagtggtagaaacctatgccaccaacagccatcatgaaagggccccaggagtctttctggttcttcatttctattcagtttgattcaacaagtgtgtattgattgaatgctttctgtgtgccaatcattgagctagccacagaggaggcaaaggtgattaagccacaattccttccctcactgagctcacagtctgatgagagaggcagataggcattgttgaagtcagcggagttgaacctagggtacttggggaatacatctgaccaagtgtgtggcagattgtattttgcaaaaatagctgcaacagtatcttccatcccacatgtctttcttacactgtgactttgatgctcctcctattcagtagtgagatctgtgttccttctccccgaatttgggcaggtctgtgactatggaagtgatgccatgtgatttccaaagccaagtcataaaaggtgatatagctccaacctggtgctgtctggagatgctcactcatggcaacccagtggccatgttgtaaggaagtccagattagccctcatagaacaaccacatgaacaggcctcatatggtagttgttctagctggcagcgatcatcagccaccagagagatgagtgaagacagccccacatgattccagctgctagccttcaagtcttctcacctaggctagagatgaggctgcagatattatggagcagaaacaaaccatctccacagtgtccttcctggagtcctgaccgaccgacaaaatgtgtgagcccataataaaatggttgttttgcaccac

SEQ ID NO: 166661 - DNA, 2792 bp, Homo sapiens
  Payload ID: 12809
  Gene Symbol: PLEKHM3
  Gene Name: pleckstrin homology domain containing, family M, member 3
  Uniprot ID: Q6ZWE6
  ENST ID: ENST00000427836
  CDS Start-End: 491-2776
agcatttcagagtgggaccgcgagaagccgcttgtaaacagagccgggccgggatggtcagcgcccgggcgggctgtcaccgtgaggcgggcggcaggctgcgggagtcaagcccctccaggagcggactgaaggccccgcaggtgaatggagagtagcagccggggcccaggaaatcaaggattggcgtggcattgctttgacaagtacttgctgttgtcttcacagaggtctcactgaagaataatctcaaaggaacatttggtctccctatacatctgttaatgcccattagccactagcaaatgcttttaattaccaggaaaacatcaaccactttgggtttggcctgctccagggagcccaatgaaggtttcttccagttgtttccatagctctattgctgaagcacccctcttggttgggtgaatgttcatgaagccatttctggaaccagcttaggaggctaaggcctcctggagcctgtgacatggaagctttggaagtggatgatatcagcccagccttagaagttacggaggaattctttagtactttggatagtaatctagaaaaggctgtgcagcaggcagaggtttatgggatccaggaagtccctgaactggtggggcatgaggtactcagtaacataacagacaatggtgctatgagaaatgtcacctccctgggcaaggggggcatgatttgggaccactgtaagagcaggctcttagaaaccaaagctcaaaatgtcttccctgccaaagaacagtttatggtccagagagggacaaccccagataatctttcctggatggaacaaaaggaagcatcaacctttaatttcttcaatatctgtcagcgtcggagggaccggcctcgttctgtaaatgacttactggatgagacctcaactttcaagccagggcatgctcgatcacgatcagatattacccaagtggactggagggtagtcctcaaaaccacgcctttgcagcagcagcaacagcagcagccattgcttcaaggcccgcatgtcaccaggccatcttttctgttgccctcaccaaataagatagaagatgctcaaggaaatactgaacacaagcagacattcccaaacattctaaagaagggttacctggagattagaaaggaccatgacagttactggcaaagctgttatgcagaactttcaccttacaacttatacttctacagcctcgacagcagtgggaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggccgccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcaggtaatagagggaaagctggctccattcttgggcaaggtcattaaatttgccacctcacacgtgtacagctgcagtctttgtagccagaaggggttcatctgtgaaatctgtaacaatggagagatcctctacccttttgaggatatttcaacaagcaggtgtgaaagctgtggagccgttttccattctgaatgcaaagaaaagtctgtcccctgcccgaggtgtgttcgccgagagctgcagaagaagcagaagtctttctggcagagactgaacatggacgagagtctagaggaggcttgcaccatgttcgagctgtcctaccagaacacctgactccagccgacccgaa

SEQ ID NO: 166662 - DNA, 2194 bp, Homo sapiens
  Payload ID: 12810
  Gene Symbol: PLEKHN1
  Gene Name: pleckstrin homology domain containing, family N member 1
  Uniprot ID: Q494U1
  ENST ID: ENST00000379407
  CDS Start-End: 31-1761
ccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggcccactgcccgcacccctcctggtgctctgccccagccgggccgagctggaccgctggctttaccacctggagaagcagacggccctcctcggggggccgcggcgctgccactcggcacccccacaggggtcctgcggagacgaactcccctggactttgcagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccgctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagcca

SEQ ID NO: 166663 - DNA, 2455 bp, Homo sapiens
  Payload ID: 12810
  Gene Symbol: PLEKHN1
  Gene Name: pleckstrin homology domain containing, family N member 1
  Uniprot ID: Q494U1
  ENST ID: ENST00000379409
  CDS Start-End: 31-2022
ccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggtgtttgggatgcttcccgggcccccagaggcactcctgacccaggacttggagaggggcctgccctgtggctgcggagcacgtgtgtgtatgtgtgtgccctctctgccctgcccgcaggcccactgcccgcacccctcctggtgctctgccccagccgggccgagctggaccgctggctttaccacctggagaagcagacggccctcctcggggggccgcggcgctgccactcggcacccccacaggggtcctgcggagacgaactcccctggactttgcagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccggaccaggccaactctgaccgtgccagcattggccgacggaggaccgagctgagacgcagtggcagcagccggtcacccgggagcaaggcccgggcagagggccgcggccctgtcaccccactgcacctggacctgacccagctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagcca

SEQ ID NO: 166664 - DNA, 2404 bp, Homo sapiens
  Payload ID: 12810
  Gene Symbol: PLEKHN1
  Gene Name: pleckstrin homology domain containing, family N member 1
  Uniprot ID: Q494U1
  ENST ID: ENST00000379410
  CDS Start-End: 36-1871
gggacccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggcccactgcccgcacccctcctggtgctctgccccagccgggccgagctggaccgctggctttaccacctggagaagcagacggccctcctcggggggccgcggcgctgccactcggcacccccacagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccggaccaggccaactctgaccgtgccagcattggccgacggaggaccgagctgagacgcagtggcagcagccggtcacccgggagcaaggcccgggcagagggccgcggccctgtcaccccactgcacctggacctgacccagctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagccagggtgccccgaggaggagggtgggtgggtccttgtgtggcctggcgcgcaccacagggcagcacgggagacgttgacaccaccggacgagaaagaaaaaa

SEQ ID NO: 166665 - DNA, 698 bp, Homo sapiens
  Payload ID: 12810
  Gene Symbol: PLEKHN1
  Gene Name: pleckstrin homology domain containing, family N member 1
  ENST ID: ENST00000491024
  CDS Start-End: 1-531
agcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgagagctccagccggagtgtcttgctgctcagacccctccgaggtccaagtcctgtcctgccactcagctccccctgcaccccagaagaaacgcagggtgcggttgcatttgatttcagataaacaacaacttcttagtaaaatgacctccccacta

SEQ ID NO: 166666 - DNA, 2050 bp, Homo sapiens
  Payload ID: 12811
  Gene Symbol: PLEKHO1
  Gene Name: pleckstrin homology domain containing, family O member 1
  Uniprot ID: Q53GL0
  ENST ID: ENST00000369124
  CDS Start-End: 279-1508
ggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccaga

SEQ ID NO: 166667 - DNA, 1809 bp, Homo sapiens
  Payload ID: 12811
  Gene Symbol: PLEKHO1
  Gene Name: pleckstrin homology domain containing, family O member 1
  ENST ID: ENST00000369126
  CDS Start-End: 1022-1702
aaggataatggtttggagacagagttctattcctgccagcattgacactgtgtctgaaaagccagcatcgacactgtgtctgcaaatccctcagctattctgagtctccgttttctccctgtgagatggagatcataaaatccgcctcatccttaggattattctcctgaagctacaataaggcctgaggcattgtacgctggaagaaacgtgtattaatagcaacttctgtcccaccccatcccccaacacgtcgatcccctccggagcataaaactttcccccagcatctgacctgcccaggccaccctagcacctaggagcgtgaattcctgatgcgggttgtgggtggcgcgccctcccggttcccgctctcgtttttgtttttggtcgggtaaggcgatgctgtagaggctggcgatctccagtcttcacgaatccgcacgtctctccattatccaccgcgcccgcccactgggccccggggcggccggcggccgggtctctcgggctccgcgtgtcgcccgagccgccgccggagcgagggtccctgccccctggggagcggtctccagccgcttcgaagccgccttcttccccctccggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaa

SEQ ID NO: 166668 - DNA, 3720 bp, Homo sapiens
  Payload ID: 12812
  Gene Symbol: PLEKHO2
  Gene Name: pleckstrin homology domain containing, family O member 2
  Uniprot ID: Q8TD55
  ENST ID: ENST00000323544
  CDS Start-End: 129-1601
cttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaacttca

SEQ ID NO: 166669 - DNA, 3569 bp, Homo sapiens
  Payload ID: 12812
  Gene Symbol: PLEKHO2
  Gene Name: pleckstrin homology domain containing, family O member 2
  Uniprot ID: Q8TD55
  ENST ID: ENST00000616065
  CDS Start-End: 135-1457
aagtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatgg

SEQ ID NO: 166670 - DNA, 3403 bp, Homo sapiens
  Payload ID: 12813
  Gene Symbol: PLEKHS1
  Gene Name: pleckstrin homology domain containing, family S member 1
  ENST ID: ENST00000354462
  CDS Start-End: 159-755
aagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctgatacggtttggatctgtgtccctaacaaatcccatgtcgagctgtggtccccggtgttggagatggagcctggtgggaggcagctggatcgtgaggtcgtgggggtggagttctcacgaaggagttagcatcatccccttggcgctgttctcgtgatagtaagttctcgtgagatctggttgtttaaaagtgtgcagcacctctccgctcactctcttcctcctgctcctgccgtgtaagatgcctgctctgtctgccacaagtgaaagcttcctgaggtctccccggaagcagatgctgccacgcttcctgtacagcctgcagaactgtggaccaatcaaacctcttttcttataaattacctggtcttggggatttctttatttaatgtgagaacgcatgcccttttggatctgctgtttctacttttataaatttatcatgcagaaatacacaaatacacaaagatacatgtaaaaaaagtagtttactgcagtactgtttgtaataataaaaaatcaggctggacgtggtggttcatgcctataattccaaccctttgggaggccgggacaggtggatcacctgaggtctggagctcgagaacaacctgaccaacatggagaaaccctgtctctactaaaaatacaaaactagctgggcattgtggcacatgcctgcaatcccagctacttgagaggctggggcaggagaatcactagaaccgggaggcggaagttgcagtgagccaagatcatgccattgcactccagcctgggcaacaagaggaaaacccagtctcaaaaaaaaaaaaaaaatcatgtgggtattgcttaattctgatttcatatcattgaacactgtagatattaaaatgttcagcaggcacagttctgtaaaattgttcgtgatacattaagaatgaaagaatcaagttgtataataaggataacatcatcccacttttgtacaaataaatgtttggtgtttgtgtgta

SEQ ID NO: 166671 - DNA, 3249 bp, Homo sapiens
  Payload ID: 12813
  Gene Symbol: PLEKHS1
  Gene Name: pleckstrin homology domain containing, family S member 1
  Uniprot ID: Q5SXH7
  ENST ID: ENST00000361048
  CDS Start-End: 328-1419
attattaatgtgtttgctttcatttttggtgctaggcagctgggacaccaaggagagttctgtggcaagccacaagtatgaaggcccagaacttcccctgagggcatagcttccatttcagtttggggcaagaataaaatctgctcaaggatattagtttgggaacttcctggtggttcagatttcaagcagagtttgtgcttaatcctcacccaggcaccaaggctcagagtcagcaggagtgagttcaggaatcctcgggacaaggcactttcctgagcactggaccagcgacctcttggcttccagggaggacacacagccatcatggaacccaaacctcagaagagtccaggcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcaaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctg

SEQ ID NO: 166672 - DNA, 2534 bp, Homo sapiens
  Payload ID: 12813
  Gene Symbol: PLEKHS1
  Gene Name: pleckstrin homology domain containing, family S member 1
  ENST ID: ENST00000369309
  CDS Start-End: 34-882
gaaaaatatggagcaggaacaggaaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctga

SEQ ID NO: 166673 - DNA, 2046 bp, Homo sapiens
  Payload ID: 12813
  Gene Symbol: PLEKHS1
  Gene Name: pleckstrin homology domain containing, family S member 1
  Uniprot ID: Q5SXH7
  ENST ID: ENST00000369310
  CDS Start-End: 563-1960
atgcctttaagtgcactaatcttttcttgtacaatatttaatctgctcttactcccatccagtgttgttgctgtttttttgagacattgtagttttcatctttaaaatttcactttaggtcttctttatatcttttatatctctccctaactttttgaaaatatagtgataataactgctttaattactttctctgccaattctaacatctgtgtcagttctaggcctgttttgattgattgactttcttctcattattgatcatgttttccttcctctttgtatgcctggtaaactttgattgactgccaaacatcgcaaattttaccttgttgtttcctgaatatctttgtattcctatgaatcttgagctttgttctgggatacagttaaattttttgggaacaactttcttctaagtctttcatgattttttaggtgggtttggagcagtgctcagtgtagaactagtaattagtgtagagctaattattcctcacactgaggcaagacattcctgagtactctacccaatgccctgtaaattataagtttttccagtatggctggaggcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcaaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggaggactctttcaggattctttcatatcaagtagcatttggagaaggcactgagctaagagacagagcacctgggttcaggacctcagatcggcatgatgtagcaaaaagagcttgcatggaatcagactggtgcagggattccaaaacagctccttcaaccaatttgtgcctcagttttcttttctgtaaaattatgactaatgatggtgctggttgttggataattaaatgaggtaatatgtgtaacgtgcttacaaaggtgactggcacatattaggtgctcaataaagctactagttacttttacttctactacaa

SEQ ID NO: 166674 - DNA, 3443 bp, Homo sapiens
  Payload ID: 12813
  Gene Symbol: PLEKHS1
  Gene Name: pleckstrin homology domain containing, family S member 1
  Uniprot ID: Q5SXH7
  ENST ID: ENST00000369312
  CDS Start-End: 692-1792
attattaatgtgtttgctttcatttttggtgctaggcagctgggacaccaaggagagttctgtggcaagccacaagtatgaaggcccagaacttcccctgagggcatagcttccatttcagtttggggcaagaataaaatctgctcaaggatattagtttgggaacttcctggtggttcagatttcaagcagagtttgtgcttaatcctcacccaggcaccaaggctcagagtcagcaggagtgagttcaggaatcctcgggacaaggcactttcctgagcactggaccagcgacctcttggcttccagggaggacacacagccatcatggaacccaaacctcagaagagtccaggtacccgaggggtataatcgcagaagcagaaatctttttattgaaaatgccccacggtttccttcaagctaaccaggatacagaacttggtggtttttgtgcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcaaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctg

SEQ ID NO: 166675 - DNA, 679 bp, Homo sapiens
  Payload ID: 12813
  Gene Symbol: PLEKHS1
  Gene Name: pleckstrin homology domain containing, family S member 1
  ENST ID: ENST00000448805
  CDS Start-End: 1-589
gcaagaacaaggctcaggaattgattggtgtctttcccctgccgatgtggaagcacagaccacaaatgaccaaaaggggtcggcctcactaactgttgtgcaattgtctatattaatcaataatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggaggactctttcaggattctttcatatcaagtagcatttggagaaggcactgagctaagagacagagcacctgggttcaggacctcagatcggcatgatgtagcaaaaagagcttgcatggaatcagactggtgcagggattccaaaacagctccttcaaccaatttgtgcctcagttttcttttctgtaaaattatgactaatgatggtgctggttgttggataattaaatgaggtaatatgtgtaacgtgcttacaaaggtgactggcacatattaggtgctcaataaagctactagttacttttacttctactacaactga

SEQ ID NO: 166676 - DNA, 3247 bp, Homo sapiens
  Payload ID: 12813
  Gene Symbol: PLEKHS1
  Gene Name: pleckstrin homology domain containing, family S member 1
  Uniprot ID: Q5SXH7
  ENST ID: ENST00000619563
  CDS Start-End: 496-1596
attattaatgtgtttgctttcatttttggtgctaggcagctgggacaccaaggagagttctgtggcaagccacaagtatgaaggcccagaacttcccctgagggcatagcttccatttcagtttggggcaagaataaaatctgctcaaggatattagtttgggaacttcctggtggttcagatttcaagcagagtttgtgcttaatcctcacccaggcaccaaggctcagagtcagcaggagtgagttcaggaatcctcgggacaaggcactttcctgagcactggaccagcgacctcttggcttccagggaggacacacagccatcatggaacccaaacctcagaagagtccaggtacccgaggggtataatcgcagaagcagaaatctttttattgaaaatgccccacggtttccttcaagctaaccaggatacagaacttggtggtttttgtaaattccagtgtagaagttggcataagtagccaggaaaagatgcaatctgtgcagaagatgtttaaatgccaccctgatgaggtcatgtccatcagaaccactaacagggaatacttcctcattggccacgacagggagaagattaaagactgggtctccttcatgtcatcatttcgccaggatataaaagcaacacagcagaacacagaggaggaactctcattgggtaataaaagaaccctcttctactccagccctctccttggcccttccagcacatcagaggctgttggctccagctcaccaagaaatggtctccaagacaagcatttaatggaacaaagttctccaggatttaggcaaactcacctacaagatttatcagaagccactcaagatgtgaaggaagagaatcattatcttactcctcgaagtgttcttttagagttggataatatcattgcttccagtgattctggtgaatccattgaaactgatggtccagaccaggtctctggaagaattgagtgtcattatgagccaatggaatcctattttttcaaagagacatcccatgagtctgtggatagcagcaaagaggaaccccagacccttccagagacccaggatggggacctccacctgcaagaacaaggctcaggaattgattggtgtctttcccctgccgatgtggaagcacagaccacaaatgaccaaaagggtaatatccccgatgaaagccaagtggagaaactgaacgttttcctttctcctcctgatgtcatcaactatcttgctctcacagaagccacaggacggatatgtgtgtctcagtgggaaggccccccacgtttgggatgcatattttgccacggagatcatcttctggcagtgaatgacctgaaaccccagagcctggaggaggtctccctgtttcttacccggtccatccagaaggagaaattaaagcttaccatcggcaggatcccaaattcagagacattccatgctgcatcctgtatgtgtccctcaaaatgccaaagtgctgcaccttctcagctggataagcctagactgaacagagctcccaagaggagtccggccattaaaaagagccagcagaaaggagccagggagtaacgcaccccagacccatggcagcagaaccaggatggagctgggactgtccagctctgccccctgctgctgccatgtgataggagacagtcggcacccccctctgaatttctgcatctgcatcttaacaatggggatgactatcccctctctggttattgtatcagagatgctaagagggtcatgtggcatgattggagaacctgggggaattggaaggccttattatctcagctattgtcccaaacaccacagacacagattgggtcagtccttcatgtaatacatgctgtgttctgtgaggatgtggtccacacaattccttctttgttaagggacatacagttgcaaatactcactgcatgaaggcaagattcccaagggagatgtgatagctgatcaggcttcccagacacctccttcccaaacacctccttcccaacacctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacacctccttcccaacacctccttcccaaacccctctttcccaaacacctccttccccaacacctccttcccaacacctccttcccccttccccaacacctccttccccaacacctccttcccaacacctccttcccaaacccctccttccccaacatccttcccaacacctccttcccaacacctccttcccaaacacctccttcccaaacacctccttcccaacacctccttccccaacacctccttcccaaacacctctttcccaaacacctccttcccagacacctccttcccaacaccgccttcccaacacctccttcccaaacccctctttcccaaacacctccttccccaacacctccttccccaacacctccttcccaacacctccttcccccttccccaacaactccttccccaacacctccttcccaaacatccccttcccaaacacctgcctctcttcaaccccacaggccagagtgctgagacagagtggccttttggattcaataagtatcttgttctcttaaagactcagcaacgattttagaagtcgcagcagttttacatcacatgcagccaagatcagcttgctctacaagcaataacagaactacttagcacttcaaggttgaaagttcttcactaatggatccattgactaattgatcctggaaggccaaaggaataaaattcttttatataaataggaaaacaaaggcagagagctaaagcactaatcaaatcggggggtgttagagcaaaaacaggcttcagaaagagtattttaccatgcttcacatggaaaaaatcgagccccggagcgatgaaaggcatattttctttgtttctccaagtttcataaccgttcagttgcagaaccaagaatctaaaaccagctctgggaaacaaatgtccagatgccagcctcatagttgaacttggatttgaaaataccttcagcacttagaagagacattcaaatacatttcatttcctgttacccagattgttcggaaagtattaaaaatttttcatttacatgctg

SEQ ID NO: 166677 - DNA, 10460 bp, Homo sapiens
  Payload ID: 12814
  Gene Symbol: PHIP
  Gene Name: pleckstrin homology domain interacting protein
  Uniprot ID: Q8WWQ0
  ENST ID: ENST00000275034
  CDS Start-End: 169-5634
gttgtttcctcctcctcctcctccgcctccgccgccgttgcttgaatggtggagccgaagctcggctcgtgaacacacactgacagctatagggcaggcggcggcaccgtccccgcttcccctcggcggcggggtgtcccgtcggcggccctgaagtgacccataaacatgtcttgtgagaggaaaggcctctcggagctgcgatcggagctctacttcctcatcgcccggttcctggaagatggaccctgtcagcaggcggctcaggtgctgatccgcgaggtggccgagaaggagctgctgccccggcgcaccgactggaccgggaaggagcatcccaggacctaccagaatctggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagctgcaagcatgttgtgtggaaaggatctgctctggctgcgttgcactgtggaagaccacctgagtcaccagttaactatggtagcccacccagcattgcggatactctgttttcaaggaagctgaatgggaaatacagacttgagcgacttgttccaactgcagtgtatcagcacatgaaaatgcataaacgaattcttggacacttgtcatctgtgtactgtgtaacttttgatcgaactggcagacggatatttactggttctgatgactgtcttgtgaaaatatgggcaacagatgatgggaggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaattttgtattagatgaacagactcagcaagcacctcatcttatgcctcccccttttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcagttatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacttgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaaaaaaaaaaaaaacaaacttacgagacacttcacttctttaaatgaatatatatatatatatataaatatatacatatatattttaaatgtttgctatttattgcccttagataggttatgcattttcacattcatttcattcactgtttgaaacgaaagaaattgatctataatgaattcctgatttatttatagaaaagacaattctgctacactctttaggagcataatattcctagtgatagagcatttcatgttaaaatgaattatttttgaccaagtgaggtacatttctattgatacaagtcatgcccctaaaagatagatgttatacagagtagcagtgaattaagaaatgtttcctctaaaagataaatataaaatttccaccatttgataccctaaacagtttaattttaattatagaatgttcatctacaaagtatctagaggaggcttttgctttattccatttctgccaaacaagagaaaatgtactgatgaagggaaacatatccacattggaaaacatttgactgtctaatttttcagaccttgattcttatatcactcaatctctgtttattgtgccaaagactgagaatcagtgcagtggaaagcctgtttttgacgtcaggacagcatacacttttcaatattggaaaggctatatattctaaagagcaagttattaaagagttatgctgagatatatctttttttggtactaatagaaaataatgcactggtgggtcctttgacagagatgttctagaggaaatgtttaagtggttaaaggattcaaggaaaatacaggaaaaaaggtatgggatttgatgtttacttgttgatctggattaatgtcatttctaaactttagacatatctaatagcctaaaatgacttacaaagaaacgtgtctgtgtgtgtatgtgtatatattgataaatgggtataattaaatatatatacaaacacatacttatatactattacccaggtataaattcttttttcaggattttttagatagcagtagaataaaaataattttaaaatgtcatactttatagtttaattttaagggggaaattggttattttcaattattaaaggttaaaataggccaaatcactttttatgcaatcatgttttatacagtggtctcattgcacattgtgttttttctgcactttttacggtatccttatcatgctggtatgtcaatatacaccctaaagaaaaactccatttaatgattgtgccttgtattctattattttttgcatcattagtaaaattaagttgtctattgtaaatgataactatatgacttaggagaatgtattgctatatgtactgctatggaaaaggaaagcagttatttatttgtttatggtacagttagttattttataccttaaaaaccaacatacttaccatttctattgtttaaaaattactgtccatttttttaaaaatttaaagaatgtagtattttctgaggactggtatggtacaaaaatgtaatcaaaattttcagatactacatttttaaaaagtgaggatggggaaaatatgtatcagcatgaccctgatgtagaaaaataaagtctgcaattgaaccttggcaaaatacattacataattatttctgataaggataaatattagctgtcatttaactgtcgtgaagaatgaaaaagtgatacatttgggctttttagatcatttgtaactaaatttgtacagaaattctcctgtgaaattaagtaaaccattttccagatcttgactgcattgctgagattttgcagttgaaaaataatttcaaatttttcaggttttttgtatatttatttttttctaacaaatatatttaactataaaattaaaattcagtagttaaactcttcataatgcagaaatggatggcttgattgtatagaaaaatgagtctttcagttacaccattcttgaaaataatagtgtatgtttgaaatttgtcattaattagttgcttttgaaggcaatctatttgaaatatgtaatttcctgatgttatctgcattgtgttaagaaaaaaataataggctataaaatcaatttttgtaaaaaaaatgtacagttttaagttgtgtacagaaaaaggaagagcgtacacagtcttagagtggaatatacctctagtacagtgtatgtgttaattccaactcaagcaaagaaatgagtatttaccatctttcctataacatgtaaatgtattattcctgttctacagacactgtatatttatgaccttatttggacattattagacactggtttcttagtaaagcacagtaacttggatcagattctttgtaaccgaaacacttaaacatgtattagtaataccaatatatttagattttatatttttataatttagcttctatgcattacagaagttgaattaagaaatttaagtcatcaccatatttttgttttctttaccacttgggaaaataatcctctttgaggcagtaacactatgtatgtactgttaataggccagaaagaaatattggcagttgtcttaggtaagcaataaaaacatctccaatttactgaaagttcagaaatataactcttacatgcatggaaagtgtaaaccaatttaggtatttctaagtacccaaccctagtattctctccctcaactccaacattctcaagtcccagatgaaaagtttcagtggagcattagtttaaatatttagtctaatcagagactcacagccctgggcaatagatacatagctttttaaaattttatcctttgtgacctgctatagtggcattggactattttctgcatgtattataaactaaagattggccttatttcaattgtttttattgcacaacttcactacaaatttaaagactgctggcattattataaaactgtcttcctccaatccaagtaaataagtatgtggaatatttgtgagctggattaggtaacatctgagacttgggattgactaaatttagttatcacttggaaatgaattacataagatacagtaatcagagaaaatatctttatgcagcatgtatgttaacatctagaactgtccctcatctgcagtgcagtagaggaatcagacattttaagaaatgtattcaaatatttttatcttatatgttagcagcatttacatgttttcagatatgatttgtaatataaattaatttctccagttaacaatgtttacttcaattctgacattccattttatacatatatacctactgtatatctctctcaaatgtcagctagaagcaactttttcagttttctatctaatgaaaacggatatattctgaatgtttttgttacctgaaatttatttttgagtaggttgaaaggaccaagatacttgagtgattaaaggactgtaagtgttctgcttatatgcaggagttacatgattttaaaagtcataataggggaagtagttttatcatctgattactcctattaacctaaaaagtatttctaacataacagattgagcagtggttttgttacacttaggcaagaatttattttcccattaaaatttgaaaaatacacttttctttgcttctacccttgcagtttcccttagttcccctaatttccaagtgatctgaactaaaattaatattacatttactaagaaactatttttgttaattatactgagcaaagtttgctccaaatgaaaagtcattacgaactatgtatagtacccaagaaaaggtcaaattgagtcagaagactgtaagtaccacttttggcgctccagagataaaccttgtacacactgcagtagaacagtgagtagaaaatatgagctataaatagatattatttttagttttgatagctctgtgttgaaatacttttttaatgcagataaaaattatcaggaaattaaccttatggcacagaccaaatacttagtgcatggctgagtttctacaattcaaggagccaagaaaataggttcaagatggaatatagtacatgcatataaggcagatgcacacatgctggttactttaagattgtgtgtgttgattagtcacaatgatagactataacatgagacaatacaaagttacatttttggaccatattaaaactgcaagaagacaggggtcttactgaagatcttttagaaaacttaaatcctgtcacaggatatttagacatgtgtagaatgtagctcaatttttaaaaagtaactgacctagagggtgaaagttgaaactgacacattttcaaattaagattatgcttattttgtacagaaaacaatgtttaaacacaagcagatctgttgtatgtaataagtaacacagagttttaaaacaaattaattatttagctttattgaagtttgtttttttccttccgaacctggagtatcatattataaacagcagtttcacaccagaatagcagtgccctttctttttgtacatactgattggacctttctttactgttacgtggacactttctatgttagttttgatgcataattctttgaatccttttatacaaactagaatgtatgtgtaagaatacctgtccctgcaatgtagtaactacaaacttatttttaaataaatagaaaacttgtttttctaagcta

SEQ ID NO: 166678 - DNA, 8069 bp, Homo sapiens
  Payload ID: 12815
  Gene Symbol: PHLDA1
  Gene Name: pleckstrin homology-like domain, family A, member 1
  Uniprot ID: Q8WV24
  ENST ID: ENST00000266671
  CDS Start-End: 2192-3397
tttttttttttaagttattttctgtaatgcattttctgtgaatttattgtcttaaaaattggcaaatatggccattttgacatatttgccaaatatgagcatatggcaactatgctcttaatttgttaagtcaccaactgttggtggtaactgttgaaataacaagagcaaagttatcaccaatctacgggatccttacactactgatattttcaataatgcaccgtagtcagacattgtagacttaacctctgagctgctcacaaaattactaaatcattctgaaatacgtaactgcaaattctgggctttaaagtctctagttaaatgggtgattttgaaaattggtggctgttcagacattttcaaatgagaatagaatgcatttgtttcagactgataaactgcagaaggttagataacaccaaacacatttgagtttctcctaagaaaatgacttgggcctccagattacatctcattttttttttttttaccctatcaagtttgtttttccatatgaaatgtctttcccaactacacctgcccttggagactgtgaataacagacttaaaggaagtatcctttccagatgagctgaagaatgtcatcctcttaaaagaatgaacagctggtcatgtagaaattctctggaatgctcacttgtcctacaaaggcaggggagcagaaaacatgtagtttttttgttattggtatacataattgtaaatcttcgagataattttactagaagtccacataattttaataattgcctttctcctgaaaagattgctaataaattaacaatgtgaaggctagaaagctggccaagcataatccggtgggactcaggattgctggctggattgtcccgtttgatcagacattgtttcttagatgaatattcaggacgccctcgtgtataaaagttgtcctttgttctgactaccttggtattaagttcgaatttcttaccatgacacacaaaggattcgattcttgcttagctctctaagctcctctcactttctcttcccctcttgaattctttgctcttgccacacaactagcagatgaactaatctatctgttccaacgtgggcacagtagcagccgtaactcttaccttggcccactctgacttgtccagccctggttgaattcttcgtatccccgtgagggtccgcacgtagttggggctgtttactaaacggatgaacttccctaccgggaggctaggtctcggttatgccttacttcccaggaagcggcttctataggcattgtttaaatgtaggagtaggagggagctgggggtattgcattccccaggtcacagataaatgagattccaaaaccaagatctggctaggccttggaaagagggacctgcgaggccgaccagacgtttggaactgcgccttgcagtgtgggatctcagcaccggatattaccccggtttgtagagagttgagttactgttttaagagacgttgcaaaccgtacgggtcaagaagaaagccgaagacgggttagcgcctgcggtcggggtcgagaaaagcaggcgagatgcgacctgacgtgggtccgcctctctccacccgtggcaagcccgacagtcgcactattgctttaacaatcgccctctttccaagaagagctacttagtgaccgtgagcgaatatgcgtgggaagacacgatgtcctctcggcctctgtgcgctcagttgtttacctaggcgtccgggggaggcacactcgcgggactcgcgggactcggccccggcctcccagctcgcccaggacacgacgctggttctgcgggctctcggagcccagcgcgaatcccccgggctaattcccaagaaccgagaggcagcactgcctggaggctgcccccgcctccgcgcccccgtcctcactttctgaggctgttagcagagagtcccgcgggccggggagaagcgggacgcgggggatggcctcgcagcgccctgtgagcgtcggcagtagtcaggcagccagggctccttgggcgatcgccctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 166679 - DNA, 5741 bp, Homo sapiens
  Payload ID: 12815
  Gene Symbol: PHLDA1
  Gene Name: pleckstrin homology-like domain, family A, member 1
  ENST ID: ENST00000602540
  CDS Start-End: 287-1069
ccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 166680 - DNA, 5913 bp, Homo sapiens
  Payload ID: 12815
  Gene Symbol: PHLDA1
  Gene Name: pleckstrin homology-like domain, family A, member 1
  Uniprot ID: Q8WV24
  ENST ID: ENST00000619060
  CDS Start-End: 36-1241
gtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 166681 - DNA, 955 bp, Homo sapiens
  Payload ID: 12816
  Gene Symbol: PHLDA2
  Gene Name: pleckstrin homology-like domain, family A, member 2
  Uniprot ID: Q53GA4
  ENST ID: ENST00000314222
  CDS Start-End: 92-550
gcagctataaaggccgcgccggggccacgaggagcagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggccagtttgcttttctaccatccggctgtggctcagtgagactcctgctgggagggtggaggcccaggaatgggcgggcaggacaccctcatccagtcctgcggggctggtgtgaaaggcgctgggaaccggctttgaatgaataaatgaatcgtgtcatctgc

SEQ ID NO: 166682 - DNA, 955 bp, Homo sapiens; identical to SEQ ID NO: 166681
  Payload ID: 12816
  Gene Symbol: PHLDA2
  Gene Name: pleckstrin homology-like domain, family A, member 2
  Uniprot ID: Q53GA4
  ENST ID: ENST00000618418
  CDS Start-End: 92-550

SEQ ID NO: 166683 - DNA, 896 bp, Homo sapiens
  Payload ID: 12817
  Gene Symbol: PHLDA3
  Gene Name: pleckstrin homology-like domain, family A, member 3
  Uniprot ID: Q9Y5J5
  ENST ID: ENST00000367309
  CDS Start-End: 230-613
aggggagggccggccagggtaggaatgcgctgcgggcgggcggcgcaggaggcgagcggcggaacatccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctca

SEQ ID NO: 166684 - DNA, 2640 bp, Homo sapiens
  Payload ID: 12817
  Gene Symbol: PHLDA3
  Gene Name: pleckstrin homology-like domain, family A, member 3
  Uniprot ID: Q9Y5J5
  ENST ID: ENST00000367311
  CDS Start-End: 399-782
gagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctacgcatcttccccccactgcggtgttcggcctgaaggtggtgggggtgagggggggtttggccattagcatttcatgtctttccccaaatgaagatgccctgcaaagggcagtaaccacacagtttgctgagtgaaattctttgcccacaaagacccagggcttggagcatctctctctttatccttaatctcccaatttgcaacccattctgaagtctccagcctggataggcagagacactaaaaccccagtagacagggccttggtggtcctaggaaggagggcccatagattctggaccgagggatgtcaagctggtcagttcagtccctatgaatgtctcttctacaggaggctaccctgcccctgctaccctgggagaagcctcagctttctgggcagagtttgtctccctgtcatttatactctcaggctttatacatttacacagtaagttctccctcctggagggttaaaaggaataatttcaacagggtgaaggcctggcacggtggctcacaactgtaatccaaggactttgggaggctgaggtgggtggatcacctgaggtcaggaatttgagaccagcctggccaacttggtgaaaccctgtctctactaaaaacaaaaattagccaggtgaggtggcacacacctatagccccagctactgggggaggctgaggcaggagaattgcttgaacctgggaggcagaggttacagtgagctgagatggcaccactgcactccagcctaggtgacaaagcagcaagacgcagtctcaaaacaacaacaacaaaaaaaacgggaaaacaggtacagacaatagctgcctggagttgtacagaaacttgattgggtaaccctggacctttccaggctgtggccagcagttgaccctgcctgcctttcctccattgttttcccatgtctgaccttccctgttgcaaagcagtggcctactacagggtctctctggagggagcaaggaggctcagtggccccattcagcaattcgaagtccctttaattgttttgtgcttccaacctgttttgttcccgttcagatttctctcgccttccaataaaaacttccctgtcctgtgccccagtccctcagagtccacaagaggttcaacttgctcatctgatgtgtgaattacatcacacagttgaatgagaatttgttaattacaacagaacttttataaatatgtcacttactgta

SEQ ID NO: 166685 - DNA, 5240 bp, Homo sapiens
  Payload ID: 12818
  Gene Symbol: PHLDB1
  Gene Name: pleckstrin homology-like domain, family B, member 1
  Uniprot ID: Q86UU1
  ENST ID: ENST00000356063
  CDS Start-End: 79-4038
gaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacg

SEQ ID NO: 166686 - DNA, 5753 bp, Homo sapiens
  Payload ID: 12818
  Gene Symbol: PHLDB1
  Gene Name: pleckstrin homology-like domain, family B, member 1
  Uniprot ID: Q86UU1
  ENST ID: ENST00000361417
  CDS Start-End: 412-4545
actaaactcattgaattagaacagcacttgtccatctcaaagaggataaattattttttgctatccaccccagctggaatttagaccagacttacaggctttctgctccttccttcagtgaagaagagtctccagggtccctctagtgcaggtcaaagaagtccagtccagctgagttcagctccctagggcctccccagccagtctcctggaccaagagctggctttgcaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtg

SEQ ID NO: 166687 - DNA, 5945 bp, Homo sapiens
  Payload ID: 12818
  Gene Symbol: PHLDB1
  Gene Name: pleckstrin homology-like domain, family B, member 1
  Uniprot ID: Q86UU1
  ENST ID: ENST00000530994
  CDS Start-End: 264-3251
ggtgtcctcctaagcctgaggccaccgcgaccgagccgagccaggctaagggaccagtgtctccctgccccccccccacctctagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggtgagtgactgccccgccagcccacctgctctcctgaggggaccctgggtagttgccatgcctcctctatgctcacacctttcacaggatgtttttcctttaattgggatctaggcaagaccagaaaggatttagagtgggtacctaaagaagagcttcctggatatttatctaaagccttcagggcaggagactaagggcttagggggctgtgacatctttcctagagagcctagccaataagggaactgcttgttgacctgagtcgggttagacattgccctctctggagggaggggatggatttgatgacttctagaaatggttgcctgagatattggctctggggacccaggagtccttgttgcttgtgtgcaatttggttgttttgaaagcccatgtctgtgcctctctctcctcttaccccctctgtgtctctaccgtaccctctgcctggggtcccccacgccagtcgagtcgcttcccgccgagcccctcccaaccgacgacccagcaggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 166688 - DNA, 5787 bp, Homo sapiens
  Payload ID: 12818
  Gene Symbol: PHLDB1
  Gene Name: pleckstrin homology-like domain, family B, member 1
  Uniprot ID: Q86UU1
  ENST ID: ENST00000528594
  CDS Start-End: 106-3093
gtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggtgagtgactgccccgccagcccacctgctctcctgaggggaccctgggtagttgccatgcctcctctatgctcacacctttcacaggatgtttttcctttaattgggatctaggcaagaccagaaaggatttagagtgggtacctaaagaagagcttcctggatatttatctaaagccttcagggcaggagactaagggcttagggggctgtgacatctttcctagagagcctagccaataagggaactgcttgttgacctgagtcgggttagacattgccctctctggagggaggggatggatttgatgacttctagaaatggttgcctgagatattggctctggggacccaggagtccttgttgcttgtgtgcaatttggttgttttgaaagcccatgtctgtgcctctctctcctcttaccccctctgtgtctctaccgtaccctctgcctggggtcccccacgccagtcgagtcgcttcccgccgagcccctcccaaccgacgacccagcaggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaa

SEQ ID NO: 166689 - DNA, 5479 bp, Homo sapiens
  Payload ID: 12818
  Gene Symbol: PHLDB1
  Gene Name: pleckstrin homology-like domain, family B, member 1
  Uniprot ID: Q86UU1
  ENST ID: ENST00000600882
  CDS Start-End: 131-4264
agcgagctcccggggaaaagcaacggtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtgagtggaa

SEQ ID NO: 166690 - DNA, 1940 bp, Homo sapiens
  Payload ID: 12818
  Gene Symbol: PHLDB1
  Gene Name: pleckstrin homology-like domain, family B, member 1
  ENST ID: ENST00000601898
  CDS Start-End: 432-737
ctgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacgg

SEQ ID NO: 166691 - DNA, 748 bp, Homo sapiens
  Payload ID: 12818
  Gene Symbol: PHLDB1
  Gene Name: pleckstrin homology-like domain, family B, member 1
  ENST ID: ENST00000532639
  CDS Start-End: 122-748
gaaggcggcggccgagaggaccccagctcggcctggcgggcctctggccacagccatgcaccgcttgggccgaggccgaggccgacccccagggacacaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcaggtagagacgggacttcaccacattggccaggctggtctccaactcccgacctcaggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagc

SEQ ID NO: 166692 - DNA, 874 bp, Homo sapiens
  Payload ID: 12818
  Gene Symbol: PHLDB1
  Gene Name: pleckstrin homology-like domain, family B, member 1
  ENST ID: ENST00000530708
  CDS Start-End: 131-874
agcgagctcccggggaaaagcaacggtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggccatgtctgtgggctccagctatga

SEQ ID NO: 166693 - DNA, 3128 bp, Homo sapiens
  Payload ID: 12818
  Gene Symbol: PHLDB1
  Gene Name: pleckstrin homology-like domain, family B, member 1
  ENST ID: ENST00000534140
  CDS Start-End: 1-1926
caggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggagagggcggagctggccgcgggacggaggcacctggaggcccgccaggcgctctacgccgagctccagacgcagctcgataactgccccgagtcagtgcgggaacagttacaggagcagctgagaagggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacg

SEQ ID NO: 166694 - DNA, 5673 bp, Homo sapiens
  Payload ID: 12819
  Gene Symbol: PHLDB2
  Gene Name: pleckstrin homology-like domain, family B, member 2
  Uniprot ID: Q86SQ0
  ENST ID: ENST00000393923
  CDS Start-End: 256-3969
tgaccacagtctgcagaggccagagagagcaggaaaggaaatggaaaggaacctcaccttcatgcttggggaaaaggagaaacctgtgttaatgtgtcttcccaacatcccactctcttcagcaatcgctggaacagccatgggccatccctgctgagtcaggaaagaagctgagggaagagtcgggattgaaaagcagcagacaaggctggcactgatcccagtttatcctttgagattcagcagaagatcctgatggaggaggaggataccaagagagaggtgcccaaggaagatggagttggtgatgtgcaacatttcgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaa

SEQ ID NO: 166695 - DNA, 5543 bp, Homo sapiens
  Payload ID: 12819
  Gene Symbol: PHLDB2
  Gene Name: pleckstrin homology-like domain, family B, member 2
  Uniprot ID: Q86SQ0
  ENST ID: ENST00000393925
  CDS Start-End: 98-3859
gagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatg

SEQ ID NO: 166696 - DNA, 5996 bp, Homo sapiens
  Payload ID: 12819
  Gene Symbol: PHLDB2
  Gene Name: pleckstrin homology-like domain, family B, member 2
  Uniprot ID: Q86SQ0
  ENST ID: ENST00000412622
  CDS Start-End: 412-4044
gtctggtgaggaaatcatcaccctaggacgtaaaccctcccgcccttctttcagctcttaaaaaaagcctgccacgaaagtccctactgcgttgctgcgaacgtagctttgagaagctggcgcccagtgatggggcaaacagccatgcccttccagcagccgtgaaagccccaacagcaaactgcctgggagcggggcaggtcaccaacttcgttgctcgaactccctgggtgcccgccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgc

SEQ ID NO: 166697 - DNA, 6127 bp, Homo sapiens
  Payload ID: 12819
  Gene Symbol: PHLDB2
  Gene Name: pleckstrin homology-like domain, family B, member 2
  Uniprot ID: Q86SQ0
  ENST ID: ENST00000431670
  CDS Start-End: 412-4173
gtctggtgaggaaatcatcaccctaggacgtaaaccctcccgcccttctttcagctcttaaaaaaagcctgccacgaaagtccctactgcgttgctgcgaacgtagctttgagaagctggcgcccagtgatggggcaaacagccatgcccttccagcagccgtgaaagccccaacagcaaactgcctgggagcggggcaggtcaccaacttcgttgctcgaactccctgggtgcccgccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctgacatcatattgttgtctgtttacacagatacatttattgctggggattgcaa

SEQ ID NO: 166698 - DNA, 1861 bp, Homo sapiens
  Payload ID: 12819
  Gene Symbol: PHLDB2
  Gene Name: pleckstrin homology-like domain, family B, member 2
  ENST ID: ENST00000478922
  CDS Start-End: 144-1703
ctgactgctcaccgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggtaatcttcatctcaacagtgattgacctcactgtttcattaaccagcatctacagggcagccttggagatggactccaggatatgtgggaatataggatattcatgttcactagccacagctgctatctttctcttctctcctgctatccttcttcttcccatatcactattaataggcttgtttggctatcttgaaggcctccaggaattaatgttaatttagttgctctgcggacttctcacaagtataaattctttaaaaacataacagaggagttgggaattttatgaaatttctgagtcttacaaacttctctttaagactatgaggaaatgctgacttgtattatttatatcattaaatttgcttgtgtatggtta

SEQ ID NO: 166699 - DNA, 5813 bp, Homo sapiens
  Payload ID: 12819
  Gene Symbol: PHLDB2
  Gene Name: pleckstrin homology-like domain, family B, member 2
  ENST ID: ENST00000477695
  CDS Start-End: 134-1879
accgcgagtcaggaggggccggcgggctcacggagggagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaaggtaatgttggcccagcaaagatactaggatttaaggtctagggctgtgcatatgctttggcatgaaaactgatgattttatcatgctaattatccaggatgttttcagtgaaatttcaatttaagaggtcattagctgagcgaggtgcagcaaattagggtgtttactgtaaagtaacaaatttgcactgtaaaaattgtagcagcacagaagagtagaaagaaagcacatttctcttctccctgcaccctttcaggttgtacacctgagtgataagcaggtgtaaaactggtgctaaaattgtcttacctgccttcctaatattttctgtgtatatatggctatctgttataggcatagacagacagacacacacatagtgttctgtactttttttccctcactaaatgccttgggtatctttgcatattagtatacatagctctacctcattctttttaatgaccaattgctcttcttttgtttgcaactaccgtttattttcagggtttttttttttttgctaataaaatccatatgcgcaaatattgtagcatatatatatttgcacaattctgcaaatgtgtctgtgggatcacttactaaaagtggaattgctgggtcaaagagtttgtgtatttttcactttactcaatatttccaaatcgtacttctaaaagaccatattaaaaaaagagtctatatatccaggtgacactttgactaagtttatatgtgcatataaacacaagtgttctccatacacttgccaaggttgcatattgtcaaaatttttcaattagccaaattgatagaagtttaatttgcttttctttaattatacatcaagttggggatctttccatatttttagttattatttgtattttttgacccacttattcatgttcttcacccatttttttaattgttttatttttcttgtgttttactgagtagtaagagctgtttgtggtaagcagatgagccttttatcataactagtctttattttgactttatttgtattttttcggcatataggagtttaagatttattggtactcataagtactatttagtcttctggttgtatgttggtttaaaattgtcatccttttgaggatttgttaaatggagtttaaggaaaaatcttttaaatttttttttctttttctttttgtacaggacttagaaccccaaaatcttttgttattacgtttttttcacacaggttaagaatttttttctacaacaatttaggttttaaatttctccaaaaatgatttgaaggagcttacaatgaaagatataaattttattggactaaaattagaataacaaaaatagtaaataggaggaaaaagcagatatgatattcacaaggtagatttacttatttaggaataagtaggattaatgtattgatttgcttaattgatgcttactattaagttcaactgtgagattctttagttaatcttttgttataagagaaggacacattgactctttaagaggaagatattgtcatggtactaaattctggcagtaatttatcacatgggcattattcaggggagtttgcgtgtttgtttagctacagcaagacttttacactgaatgttcctagtcagaaatcattatctacctagtgagtttttccatgatacacatcaggacttcggactgttgaatacatgttggacatcaatcccttcttttttctttctttctttttttttgagacagagtcttgctctgtcacccaggctggagtgcagtggtgcaatctaggctcactgcaacctctgccttccgggttcaagcgaatctcctgcctcagcctcccgagtagcggtgactacaggcacacgccaccatgcctggctaatttttgtatttttagtagagacaaggtttcaccctgttggctaggccagtctcgaactcctgacctcaagtgatctgcctgcctcggcctcccaaagtgctgggatgacaagggtgcgccactgagccctacccatcccttctttttgctatagtgaccatgtttaccttactaattctcaatggagactaattctgaacaggacatctgtttctgtgggcagagagttgcaatgattagaaaccaggatagggaagaaagtaggggcagggggaatcaaaagttgttgttcaggcacagtaaatgacccatcacttgaaaagttgagctgttgtcatcagccattgggcttccttagaaaccctttgcttccttttgatcttaaatcttttcacatatcttcctttatggagatctgccagttttttgttaaaaacattaagctgtgtgctgtctctaaagactatcttttgggagacaggtttcctcctggagagggctatgacaagaatgctgttggtgcgtacacgagcagatcttggcagatgtttttaattgctcaagcgtgtaattgtggaataggaggcctctgaagcttagtgcagcatctgttgttgcaagagaggtaagactctgcatcctttagaggcaggaaacatcaaggacacccaggttaccagacagcagtgtagaaagagtacaagtgagcagagctgatggattccaagaaacacatttttttacttattactttctgaaggtggacatatattaccttgagacagcagacagaaaattctttttaaaacaaccttcctatttgttttgcatgctctttctcttcaattaatttccacactggattatttgcctaacaaagtacaatgttaataatcgatttagggataaatggagaagagaggaatgtgaaaaacactgtaagttgacttaactatacagaacaatcttaatgatatttagaaaacctgagagttaccagtcaagaacttgctttatgtaacacttacagatgcagatgactttggaaatatgctaattttagttggcctttgtgaaccaccccctgaggtaaaagttgtctggaaagtggctcatcttcctccttttgagtcccttgcacccctctctcctttggctgcaaaaagggttttaagaagaaatctgtgaaaaaggggcaagcagaaagtgtcttttcccctatcatctctcccctttcctgtgtggatcaagtttccccaaagataacatattagaggatgcatatacacacgtaatgtgcttattaaaacatgtcactgttagtagattcctgtccattactggaaaaaaaaattcccagagaaattaaaatgaagggcatatgtttaaaattacaatgttctctgtcactgtaaaacttaaagctactcagtggctaccacaccttggctttctattggttttctttatttggttaataaatgagattacattgtcctcaccccattctatcataaagcgtttggttttagaatgcttcctggagattttgcttcttataaataacttagaaaaaaactacaaacatttcctagatggcatttattgctataaacagactcttaagttgtctattattaaatatatctactgtgataaactttctaaaaactttgaattatgcagatgattcccactattaaccatctttactccctacttgcttataaagtttagagttttgcagattgttctgttattttgtatttttcttaatgccttgcttccacctgtgaaagagatatttttaagccattttggaagtagaaacctaatatgtaatcttgacccaacaggataccgcccttggtgaggctttcctgctaggattactcacagtgattctggaatgccatttcactgttacaggcattcctcatggcttaaaacaggcaccttagtattaggacaatgagctttattgtctgtgataaaaaggtcaacagttgttttattagttgataagatatttcatgtaagatgacaattaaaaagctaaatgtcaaa

SEQ ID NO: 166700 - DNA, 3646 bp, Homo sapiens
  Payload ID: 12819
  Gene Symbol: PHLDB2
  Gene Name: pleckstrin homology-like domain, family B, member 2
  ENST ID: ENST00000498699
  CDS Start-End: 301-3646
agaagctggcgcccagtgatggggcaaacagccatgcccttccagcagccgtgaaagccccaacagcaaactgcctgggagcggggcaggtcaccaacttcgttgctcgaactccctgggtgcccgccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaa

SEQ ID NO: 166701 - DNA, 5474 bp, Homo sapiens
  Payload ID: 12819
  Gene Symbol: PHLDB2
  Gene Name: pleckstrin homology-like domain, family B, member 2
  Uniprot ID: Q86SQ0
  ENST ID: ENST00000481953
  CDS Start-End: 116-3748
aggtcagactgcaagattgtttgttcagatgtaggcctaacaagggattgttcttttaaaatcttctttaaggcaaaattttctgttttatttctttacagattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctcttatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagagggctatatcagtgtaaatgagattaatgagccgtgtggcaattccacgaatctatccccttccactcagtttcctgctgatgctgatgctgttgccactgagcctgccacagctgtgctggcgagccagccacagagtaaagagcactttagaagtctggaagaaaggaaaaaacagcataaagaaggcctctatctgagtgatactttgcctcgaaagaaaaccacatcttccatctccccacatttcagcagtgctactatggggagaagcatcaccccaaaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagtta

SEQ ID NO: 166702 - DNA, 4159 bp, Homo sapiens
  Payload ID: 12819
  Gene Symbol: PHLDB2
  Gene Name: pleckstrin homology-like domain, family B, member 2
  ENST ID: ENST00000495180
  CDS Start-End: 23-2257
atagggtgcagaagagcccaagatgagagtgtgtagctatgagtgcctgccgtgggaagaggccatgaggacggagctgcagctggagtccagaagttcaggcagtgaaagggaggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtgaaagaaaagaataatttaataatgatgttgcaaagagaaaaggagaatctttgtaatttggaaaagaaatactccagcctctctggggggaaagggtttcccgttaaccccaatactttaaaagaggcccatctgcccctaggacagagtaacagctgtggaagtgtgctccctccctcactggcagccatggccaaagactcagaatctcggaggatgctcagaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctagtgccagcacttcaaatattgctagaatagaagaaatggagagacttttgaagcaggctcatgcagaaaagacgcggctgctcgaatccagggaacgggaaatggaagccaaaaaacgagccctggaagaagaaaaacgacgccgggaaatcctggaaaaacgattacaggaagaaactagccagaggcagaagttaatagaaaaggaagtaaaaataagggagagacaaagggcacaggctcgtcctttgacacgctacctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctcttattatgcagacaagcatgaaactaaattgaaaggagtaatatactttcaagccattgaagaagtctattatgatcacctcaagaatgctaataagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttctaataaactgtttttaatcagttgtcggatttggtgaaataaactaaacaggttacagaatatctgtatgtacttggaaatacagaataactttatcacccaaatcactggcattgacattattggtaatcaactggctttttttaaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatgtatatatatatgtagtaaaccactttttgtaaaagaagaaagagcaaaaagctgtgtgttttagaaaaaaaagccaggttacgcaacaggcattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcaacataactatgaaatcatagctctgttttcaccaaagaacagaccaattaacatacttatttgcagaagtggtgtagttctataaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacgtatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaataaactcatctcttattttgaagttacctatctgtagtatgatggaggatgaattaatcgcaaatgacagttgtagaaactatgtaaagtttgttgtgtgctaacattatgatttgtagtgtataaactgaagtattccaatagaagtatctctggttacatcctattgcttacaaaatgaaatgaaccctgaaaaactctg

SEQ ID NO: 166703 - DNA, 2591 bp, Homo sapiens
  Payload ID: 12820
  Gene Symbol: PHLDB3
  Gene Name: pleckstrin homology-like domain, family B, member 3
  Uniprot ID: Q6NSJ2
  ENST ID: ENST00000292140
  CDS Start-End: 362-2284
ggtggggccgggccggggccggtggggccgggatggccggatgccgaggccacgggtggggcaagcccgtggctccctcctccctcgggagctgttggacctgttgtcccccctccacttccgggctgctggggagggggaccgggcggcctctctcctccctcttcccctgccacctgtctcataggcagaagcggccgtgcccagcgcgcagagcggagcgcgccgaagcctgagctcgtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcgggaacaggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagaaggggtgctctgcagcaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcagggctccattggcctccagaggactgggagcctgccccggaaaaggggggagagggggagccagagaggatccccccgacctctgtccttccattgtactgaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgaccgccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggaggaaaaacaggaa

SEQ ID NO: 166704 - DNA, 366 bp, Homo sapiens
  Payload ID: 12820
  Gene Symbol: PHLDB3
  Gene Name: pleckstrin homology-like domain, family B, member 3
  ENST ID: ENST00000596141
  CDS Start-End: 1-366
tgccacccctacttcttcctgcctcttttctgtccacagctccctgcagaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccg

SEQ ID NO: 166705 - DNA, 546 bp, Homo sapiens
  Payload ID: 12820
  Gene Symbol: PHLDB3
  Gene Name: pleckstrin homology-like domain, family B, member 3
  ENST ID: ENST00000601646
  CDS Start-End: 244-546
gccgaagcctgagctcgtgagggggccgaggctgtggggaggtggcagttggacttcggaatctcaaggactccgactcctggcttgttcagagaaggagagccccgactcctggatccctgggccccgcctccttgggggggggtctccgcgccccggagcagacgcgagcggcgctcagccgtcctaggccccgcccccggagcttctggtcccgcccaccccgcaggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctg

SEQ ID NO: 166706 - DNA, 2286 bp, Homo sapiens
  Payload ID: 12820
  Gene Symbol: PHLDB3
  Gene Name: pleckstrin homology-like domain, family B, member 3
  Uniprot ID: Q6NSJ2
  ENST ID: ENST00000599242
  CDS Start-End: 362-1201
ggtggggccgggccggggccggtggggccgggatggccggatgccgaggccacgggtggggcaagcccgtggctccctcctccctcgggagctgttggacctgttgtcccccctccacttccgggctgctggggagggggaccgggcggcctctctcctccctcttcccctgccacctgtctcataggcagaagcggccgtgcccagcgcgcagagcggagcgcgccgaagcctgagctcgtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcgggaacaggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagagtgagtcatgcctgaccagcgctgccccccttgctgctcctctctgtctcccctgctctgtgcctgcctttttctctgtccttgtttcctgcctgtcatgttcttctgaatagtaacaacaagagctgatactaatgaaacatttactatgtgccagatatggtcctgaatatttcatgagcatttcctcactgaatccttacaacaaacttatgaggcaagttctattacgttttttttttttcacgttataaataaagaagctgaaggtcaaggtgcttaagtaatcttttccaagtttccttagtaagggacagagccaggatttttttatttttattttttgagatagcgtctcactctgtcacccaggctggagtgcagtgacacgttcacagctcactgcagcctccacgtcctgtgcttaagcgatcctcccacctcagcctctcgagtagctgggaccacaggtgcgagcccctacacctggataatttttgtatttttagtagagacagggtttcacctggtcttaaactcttggattcaagcgatcctcccaccttggcctttcaagatgctgggattacagacatgagccaccgtgcctcgccacagccaggatttgaacaaacttggtattcaccaccacattctttgcctctattccaaaaagatgcttcatcagatccttcctgggagcctcacattcaagggtctgacttgtgagacccttgggaaaaaatgggcatgtttgaccatatttaacacagagtttcccaaagttttggattagaaagctcggccgggctcggtggctcactcctgtaatcccagcactttgggaggccgaggcaggcagatgacctgagtttgggagtttgagaccagcctgaccaacatggagaaagcccatctctactaaaaatacaaaattagctgagggtggtgacgcatgcctgtaatcccagctactcgggaggctgaggcagagaattgcttgaatccgggaggcggaggtggcggtgagccgagattgagccattgcactccagcctgggcaacaacagcaaaactccatctcaaaaaaaaaaaaaaaa

SEQ ID NO: 166707 - DNA, 696 bp, Homo sapiens
  Payload ID: 12820
  Gene Symbol: PHLDB3
  Gene Name: pleckstrin homology-like domain, family B, member 3
  ENST ID: ENST00000600660
  CDS Start-End: 1-696
cagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagacaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcaggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggc

SEQ ID NO: 166708 - DNA, 627 bp, Homo sapiens
  Payload ID: 12820
  Gene Symbol: PHLDB3
  Gene Name: pleckstrin homology-like domain, family B, member 3
  ENST ID: ENST00000594808
  CDS Start-End: 297-627
ctagagatgagggaggggaggcggggtcgaagaggtcagtagggggcgtgctacgacccggactcaaattccggtcccgtctccggtggcgtgtcgccttggagccatcaagccccgcctctggaaacttcaggacacgcctccgtaacgctcagttccatcctttgaactcttaggccccgcctccttgggggggggtctccgcgccccggagcagacgcgagcggcgctcagccgtcctaggccccgcccccggagcttctggtcccgcccaccccgcaggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactc

SEQ ID NO: 166709 - DNA, 15249 bp, Homo sapiens
  Payload ID: 12821
  Gene Symbol: PLEC
  Gene Name: plectin
  Uniprot ID: Q15149
  ENST ID: ENST00000322810
  CDS Start-End: 171-14225
gagcccgcgccctcacgctcagcaccccagcctgcctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166710 - DNA, 14803 bp, Homo sapiens
  Payload ID: 12821
  Gene Symbol: PLEC
  Gene Name: plectin
  Uniprot ID: Q15149
  ENST ID: ENST00000345136
  CDS Start-End: 130-13773
tgagctgagcctgtgccgagtgagcgtctcgtggggccgccagccttcagctgcctgtgtgccacacggggctgcccagagcaccgtgcctgaggccgagggtccgggcgacgaaggtgtgggggcagcatgtctcagcaccagctccgcgtgccgcagcccgagggcctgggccgaaagagaaccagctcggaggacaacctgtacctggctgtgctcagggcctctgagggcaagaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttcccgtg

SEQ ID NO: 166711 - DNA, 14736 bp, Homo sapiens
  Payload ID: 12821
  Gene Symbol: PLEC
  Gene Name: plectin
  Uniprot ID: Q15149
  ENST ID: ENST00000354589
  CDS Start-End: 69-13712
gctgtctagcctggagcagccggttcccagcgcaggaagggcagccctggcggctccgcgtggcggctatggagccctcgggcagcctgtttccctccctggtggttgtgggtcacgttgtcaccctggccgctgtgtggcactggcgcaggggacgtcggtgggcgcaggacgagcaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166712 - DNA, 14751 bp, Homo sapiens
  Payload ID: 12821
  Gene Symbol: PLEC
  Gene Name: plectin
  Uniprot ID: Q15149
  ENST ID: ENST00000354958
  CDS Start-End: 150-13727
attgatcagctgaagccccgcccctggccggcaagccctgccccggacctccgggctcctcccccggctgcggcgctggcctgggcagtgcggtgcggggctggactctgcctggtggtggcacagccgccctcagccccggcgcagacatggacccctcgcgagccatccagaacgagatcagctccctcaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166713 - DNA, 14683 bp, Homo sapiens
  Payload ID: 12821
  Gene Symbol: PLEC
  Gene Name: plectin
  Uniprot ID: Q15149
  ENST ID: ENST00000356346
  CDS Start-End: 58-13659
agagtggccgccgggtgctggaggctccgctgcaccccgcgccccgcgcccgccggcatggccggcccgctgcccgacgagcaggacttcatccaggcctacgaggaggtgcgcgagaagtacaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166714 - DNA, 14689 bp, Homo sapiens
  Payload ID: 12821
  Gene Symbol: PLEC
  Gene Name: plectin
  Uniprot ID: Q15149
  ENST ID: ENST00000357649
  CDS Start-End: 10-13665
gtggccggcatgtcgggggcggggggcgcctttgcctcgccgagggaggtcttgctggagcggccgtgctggctggacgggggctgcgagccggcccgcaggggctacctctaccagcagctgtgctgcgtagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166715 - DNA, 14646 bp, Homo sapiens
  Payload ID: 12821
  Gene Symbol: PLEC
  Gene Name: plectin
  Uniprot ID: Q15149
  ENST ID: ENST00000398774
  CDS Start-End: 75-13622
cctccgaggggcctgtgacctcccacacccctggcccgctccgtctgccccgtgggctcctgccaccgtccccgatgaagatcgtgcccgatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166716 - DNA, 14787 bp, Homo sapiens
  Payload ID: 12821
  Gene Symbol: PLEC
  Gene Name: plectin
  Uniprot ID: Q15149
  ENST ID: ENST00000436759
  CDS Start-End: 39-13763
ggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 166717 - DNA, 583 bp, Homo sapiens
  Payload ID: 12821
  Gene Symbol: PLEC
  Gene Name: plectin
  ENST ID: ENST00000526416
  CDS Start-End: 14-583
ctgtgtggcagccatggacaggtacagcatggaggagctgattcagctgggccaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcag

SEQ ID NO: 166718 - DNA, 598 bp, Homo sapiens
  Payload ID: 12821
  Gene Symbol: PLEC
  Gene Name: plectin
  ENST ID: ENST00000527303
  CDS Start-End: 1-598
aggtccagtcgggatcagagagtgtcatccaggagtacgtggacctgcgtacgcactacagcgagctgaccacactgacgagccagtacatcaagttcatcagcgagactctgcggcgcatggaggaggaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccg

SEQ ID NO: 166719 - DNA, 583 bp, Homo sapiens
  Payload ID: 12821
  Gene Symbol: PLEC
  Gene Name: plectin
  ENST ID: ENST00000527816
  CDS Start-End: 334-583
ttcatctctgcttactgactaaggggtggctgcgaggaggagccgctgctaccagggcatgagtgggccctccctctgcctcccaccccttccctccttcctgcctcgccttcctccctgccggctctcggagcagcctggcctgtgtggcagccatggacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcc

SEQ ID NO: 166720 - DNA, 13713 bp, Homo sapiens
  Payload ID: 12821
  Gene Symbol: PLEC
  Gene Name: plectin
  Uniprot ID: Q15149
  ENST ID: ENST00000527096
  CDS Start-End: 1-13713
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctga

SEQ ID NO: 166721 - DNA, 564 bp, Homo sapiens
  Payload ID: 12821
  Gene Symbol: PLEC
  Gene Name: plectin
  ENST ID: ENST00000528131
  CDS Start-End: 43-564
ctcggtgttggagggctgagagggagggaagggggagccaccatggatcaggtgagaagcctctccacagaggcctggcgaggtccaccctgctgcagcagagcaggtgcctgcgtgaggagggcctccagagggcagcggcagggctgtggtgggacctgcttgtgctcggagagcactggctgctgttgtccagtgcttggagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggac

SEQ ID NO: 166722 - DNA, 2115 bp, Homo sapiens
  Payload ID: 12821
  Gene Symbol: PLEC
  Gene Name: plectin
  ENST ID: ENST00000528025
  CDS Start-End: 7-2115
gaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaagcactggcgggcagaggcccagaggcacatcagtgacctgtatgaagacctccgcgatggccacaacctcatctccctgctggaggtcctctcgggggacagcctgccgagggagcgggacgtaagcaggagctcacgcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcg

SEQ ID NO: 166723 - DNA, 7322 bp, Homo sapiens
  Payload ID: 12822
  Gene Symbol: PLAG1
  Gene Name: pleiomorphic adenoma gene 1
  Uniprot ID: Q6DJT9
  ENST ID: ENST00000316981
  CDS Start-End: 481-1983
ggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagacttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactccctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatatcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgtggagaaatgtaaattgtaataatgtaaatgggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaattatagaatggctttagataa

SEQ ID NO: 166724 - DNA, 1684 bp, Homo sapiens
  Payload ID: 12822
  Gene Symbol: PLAG1
  Gene Name: pleiomorphic adenoma gene 1
  Uniprot ID: Q6DJT9
  ENST ID: ENST00000423799
  CDS Start-End: 284-1540
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgattggccaaaatgggaaggattggattccactctcttccacgaagagtcaatgggactggctaagatcaaagtctgaggctttttccatcagtaatcaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaataga

SEQ ID NO: 166725 - DNA, 1899 bp, Homo sapiens
  Payload ID: 12822
  Gene Symbol: PLAG1
  Gene Name: pleiomorphic adenoma gene 1
  Uniprot ID: Q6DJT9
  ENST ID: ENST00000429357
  CDS Start-End: 397-1899
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtag

SEQ ID NO: 166726 - DNA, 3663 bp, Homo sapiens
  Payload ID: 12823
  Gene Symbol: PLAGL1
  Gene Name: pleiomorphic adenoma gene-like 1
  Uniprot ID: Q9UM63
  ENST ID: ENST00000354765
  CDS Start-End: 1150-2541
ccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcaggattgttcctgcctgattcataaacatcgtgattggcttttgattgctgtcacgtctaatgtggctgctgcctcgtgtcacatctgaaactcatctgtacctcacttagaaagtttctttctataacacaagcctgaacatattgctctcctgattaacaactttcagtggttctgattagacaagacttttcgttgcagtcgacagaaacctaatgggaccattgaagaattccaaacagggtctttataagcttcttctgaaggtctcagacattcagccacggaactcaagtggaatttgtttggataacgtgactgatttcaaagcccggaccccttagacgtgcccatttggtgctgcaagtatttgcataggaatcagaggagttaatcttcttcattccctgacgatgtacaaggtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc
